US010214784B2

(12) United States Patent
Ritchie et al.

(10) Patent No.: US 10,214,784 B2
(45) Date of Patent: Feb. 26, 2019

(54) GENETIC MARKERS ASSOCIATED WITH INCREASED FERTILITY IN MAIZE

(71) Applicant: Syngenta Participations AG, Basel (CH)

(72) Inventors: Steven William Ritchie, Cary, NC (US); Satya P. Chintamanani, Grimes, IA (US); Molly Dunn, Raleigh, NC (US); Elhan Sultan Ersöz, Johnston, IA (US); David Jay Foster, Ankeny, IA (US); Nicolas Federico Martin, Johnston, IA (US); David Stewart Skibbe, Apple Valley, MN (US); Dominic Michael Tucker, Normal, IL (US)

(73) Assignee: Syngenta Participations AG, Basel (CH)

( * ) Notice: Subject to any disclaimer, the term of this patent is extended or adjusted under 35 U.S.C. 154(b) by 0 days.

(21) Appl. No.: 15/117,491

(22) PCT Filed: Feb. 20, 2015

(86) PCT No.: PCT/US2015/016877
§ 371 (c)(1),
(2) Date: Aug. 9, 2016

(87) PCT Pub. No.: WO2015/127248
PCT Pub. Date: Aug. 27, 2015

(65) Prior Publication Data
US 2017/0166983 A1 Jun. 15, 2017

Related U.S. Application Data

(60) Provisional application No. 61/942,720, filed on Feb. 21, 2014.

(51) Int. Cl.
| | | |
|---|---|---|
| C12Q 1/68 | (2018.01) | |
| C12N 15/82 | (2006.01) | |
| A01H 5/10 | (2018.01) | |
| C12Q 1/6895 | (2018.01) | |
| C12Q 1/6827 | (2018.01) | |
| A01H 1/02 | (2006.01) | |
| A01H 1/04 | (2006.01) | |

(52) U.S. Cl.
CPC ....... *C12Q 1/6895* (2013.01); *C12N 15/8286* (2013.01); *C12Q 1/6827* (2013.01); *A01H 1/02* (2013.01); *A01H 1/04* (2013.01); *A01H 5/10* (2013.01); *C12N 15/8279* (2013.01); *C12Q 2600/13* (2013.01); *C12Q 2600/156* (2013.01)

(58) Field of Classification Search
None
See application file for complete search history.

(56) References Cited

U.S. PATENT DOCUMENTS

| | | | |
|---|---|---|---|
| 5,981,833 A | 11/1999 | Wise et al. | |
| 6,137,033 A * | 10/2000 | Estruch et al. | .... C12N 15/8286 800/302 |
| 6,710,233 B2 * | 3/2004 | Delzer | ............. A01H 5/10 800/320.1 |
| 8,232,456 B2 * | 7/2012 | Long et al. | ........ C12N 15/8286 800/302 |
| 2003/0140367 A1 | 7/2003 | Miller | |
| 2006/0015968 A1 | 1/2006 | Albertsen et al. | |
| 2010/0167403 A1 * | 7/2010 | Register, III | ....... C12N 15/8201 800/278 |
| 2010/0212041 A1 | 8/2010 | Frankard | |
| 2011/0162100 A1 | 6/2011 | Kushalappa et al. | |

FOREIGN PATENT DOCUMENTS

WO    WO 2005/083096    9/2005

OTHER PUBLICATIONS

Upadyayula et al. Theoretical and Applied Genetics 113: 1395-1407 (2006).*
Upadyayula et al. Theoretical and Applied Genetics 112: 592-606 (2006).*
Puchta et al. Trends in Plant Science 1(10): 340-347 (1996).*
Mickelson et al. Crop Science 42(6): 1902-1909 (2002).*
Arizona Genomics Institute, Maize Chromosome 5 map (2008).*
Maize Genomics Database, Maize Chromosome 5 markers (2011).*
International Preliminary Report on Patentability Corresponding to International Application No. PCT/US2015/016877; dated Aug. 23, 2016.
International Search Report Corresponding to International Application No. PCT/US2015/016877; dated Jul. 20, 2015.
Supplementary European Search Report for EP application No. 15751795.4 dated Jul. 5, 2017.
Zhang, Z.F. "AFLP and PCR-based markers linked to Rf3, a fertility restorer gene for S cytoplasmic male sterility in maize," Mol. Gen Genomics (2006) 276:162-169.

* cited by examiner

*Primary Examiner* — David T Fox
(74) *Attorney, Agent, or Firm* — Gregory W. Warren

(57) ABSTRACT

The present invention relates to methods and compositions for identifying, selecting and/or producing a maize plant or plant part having increased fertility. A maize plant or plant part that has been identified, selected and/or produced by any of the methods of the present invention is also provided.

19 Claims, 2 Drawing Sheets
Specification includes a Sequence Listing.

| Temperature (°F) | Relative Humidity (%) | Vip3 Homozygous | Vip3 Hemizygous | Vip Null |
|---|---|---|---|---|
| 85 | 49 | 6.0 | 4.4 | 2.3 |
| 80 | 51 | 5.8 | 3.2 | 1.7 |
| 74 | 61 | 4.9 | 1.6 | 1.0 |

| Final Anther Scale |
|---|
| 1 = exceptional anther extrusion |
| 2 = good anther extrusion, normal |
| 3 = reduced anther extrusion, below normal |
| 4 = sparse, scattered anthers |
| 5 = very sparse anthers, but more than 15 total |
| 6 = 15 or fewer total anthers extruded |

Fig. 1

GENETIC MARKERS ASSOCIATED WITH INCREASED FERTILITY IN MAIZE

STATEMENT OF PRIORITY

This application is a 35 U.S.C. § 371 national phase application of International Application Serial No. PCT/US2015/016877, filed Feb. 20, 2015, which claims the benefit, under 35 U.S.C. § 119 (a) of U.S. Patent Application No. 61/942,720, filed Feb. 21, 2014, the entire contents of each of which are incorporated by reference herein.

STATEMENT REGARDING ELECTRONIC FILING OF A SEQUENCE LISTING

A Sequence Listing in ASCII text format, submitted under 37 C.F.R. § 1.821, entitled 9207-115 ST25.txt, 1,849,062 bytes in size, generated Aug. 9, 2016 and filed via EFS-Web, is provided in lieu of a paper copy. This Sequence Listing is hereby incorporated herein by reference into the specification for its disclosures.

FIELD OF THE INVENTION

The present invention relates to compositions and methods for identifying, selecting and producing maize plants having increased fertility.

BACKGROUND

Vip3 proteins have been successfully expressed in transgenic plants such as maize and cotton. For example, hybrid transgenic maize plants can express Vip3A proteins at levels which are insecticidal to pest insects and which have no negative impact on the plant phenotype. Thus, the Vip3A trait protects yield and yield potential of hybrid maize plants. However, Vip3 has been observed to cause decreased male fertility in certain inbred maize plants under normal growing conditions. This phenomenon is more prominent in inbred maize plants that are homozygous for a vip3A transgene. The degree to which male fertility is decreased is inbred specific—some inbreds exhibit little or no reduction in male fertility when homozygous for a vip3 gene, other inbreds are somewhat sensitive to Vip3 and exhibit a significant reduction in male fertility when homozygous for a vip3 gene, and other inbreds are highly sensitive to Vip3 and exhibit extremely low or no male fertility when homozygous for a vip3 gene. The degree to which male fertility is decreased is also affected by environmental factors, such as water availability and temperature. In Vip3—induced reductions in male fertility, drought and high temperature conditions exacerbate the reduction in male fertility; however, cooler growth conditions have been shown to mitigate the negative effects of Vip3 expression on male fertility.

Identifying genetic loci that enhance the fertility of maize plants expressing a vip3 transgene could lead to more efficient crop production by allowing for the identification, selection and production of vip3-expressing inbred maize plants with increased male fertility.

SUMMARY OF THE CLAIMED INVENTION

The present invention provides maize plants having increased male fertility, as well as compositions and methods for identifying, selecting and producing such plants.

In some embodiments, methods of identifying a maize plant or plant part having one or more characteristics associated with increased male fertility are provided. Such methods may comprise detecting, in a maize plant or plant part, a marker associated with increased male fertility.

In some embodiments, methods of producing a maize plant having one or more characteristics associated with increased male fertility are provided. Such methods may comprise detecting, in a maize plant part, the presence of a marker associated with increased male fertility and producing a maize plant from said maize plant part. Such methods may further comprise introducing the marker into said maize plant part.

In some embodiments, breeding methods are provided. Such methods may comprise detecting, in a maize plant or plant part, the presence of a marker associated with increased male fertility (e.g., in nucleic acid, for example, in an amplification product from a nucleic acid sample from the plant or plant part) and selecting said maize plant or plant part for breeding. In embodiments, the method may further comprise crossing the maize plant (or an ancestor, progeny or sibling thereof) with a second maize plant that optionally lacks the marker to produce a progeny maize plant, which optionally comprises the marker.

Still further, the invention provides a method for producing a plant having one or more characteristics associated with increased male fertility, comprising: selecting from a diverse maize plant population a maize plant comprising a marker associated with increased male fertility as described herein; and crossing the maize plant (or an ancestor, progeny or sibling thereof) with itself or a second maize plant to produce a progeny plant comprising the marker, thereby producing a plant having one or more characteristics associated with increased male fertility. In embodiments, the second maize plant does not comprise the marker. In embodiments, the marker is detected in nucleic acid from the first maize plant and/or progeny plant (e.g., in an amplification product from a nucleic acid sample from the maize plant and/or progeny).

In some embodiments, methods of reducing costs associated with breeding and/or seed production are provided. Such methods may comprise detecting, in a maize plant or plant part, the presence of a marker associated with increased male fertility and selecting said maize plant or plant part for breeding.

In some embodiments, methods of predicting male fertility are provided. Such methods may comprise detecting, in a maize plant or plant part, the presence of a marker associated with increased male fertility (e.g., in nucleic acid from the plant or plant part), wherein the presence of the marker predicts a likelihood of increased male fertility.

In some embodiments, methods of identifying a maize plant or plant part comprising at least one allele associated with increased male fertility are provided. Such methods may comprise detecting, in a maize plant or plant part (e.g., in nucleic acid from the plant or plant part), a marker associated with increased male fertility.

In some embodiments, methods of producing a maize plant or plant part having one or more characteristics associated with increased male fertility are provided. Such methods may comprise introducing a nucleic acid comprising at least one allele associated with increased male fertility into the genome of a maize plant part and producing a maize plant from said maize plant part. Such methods may further comprise detecting a marker associated with increased male fertility and/or the allele associated with increased male fertility in nucleic acid (e.g., in a nucleic acid sample) from said maize plant or plant part. In embodiments, the marker and/or allele is detected in an amplification product from a nucleic acid sample from said maize plant or plant part.

In some embodiments, methods of improving pollen production are provided. Such methods may comprise introducing a nucleic acid comprising at least one allele associated with increased pollen production into the genome of a maize plant part and producing a maize plant from said maize plant part. Such methods may further comprise detecting a marker associated with increased pollen production and/or the allele associated with increased pollen production in nucleic acid (e.g., a nucleic acid sample) from said maize plant part. In embodiments, the marker is detected in an amplification product from a nucleic acid sample from said plant or plant part.

In some embodiments, methods of producing a maize plant or plant part having one or more characteristics associated with increased male fertility are provided. Such methods may comprise introducing a genomic region associated with increased male fertility into the genome of a maize plant part and producing a maize plant from said maize plant part. Such methods may further comprise detecting a marker associated with increased male fertility and/or the genomic region associated with increased male fertility in nucleic acid (e.g., a nucleic acid sample) from said maize plant part. In embodiments, the marker is detected in an amplification product from a nucleic acid sample from the maize plant or plant part.

In some embodiments, methods of improving pollen production are provided. Such methods may comprise, consist essentially of or consist of introducing a genomic region associated with increased pollen production into the genome of a maize plant part and producing a maize plant from said maize plant part. Such methods may further comprise detecting a marker associated with increased pollen production and/or the genomic region associated with increased pollen production in nucleic acid (e.g., a nucleic acid sample) from said maize plant part. In embodiments, the marker is detected in an amplification product from a nucleic acid sample from the maize plant or plant part.

In some embodiments, methods of producing a maize plant or plant part having one or more characteristics associated with increased male fertility are provided. Such methods may comprise introducing a genomic region comprising one or more transgenes associated with increased male fertility into the genome of a maize plant or plant part.

In some embodiments, methods of improving pollen production are provided. Such methods may comprise introducing a genomic region associated with increased pollen production into the genome of a maize plant or plant part and producing a maize plant from said maize plant part.

In some embodiments, methods of producing a maize plant or plant part having one or more characteristics associated with increased male fertility are provided. Such methods may comprise crossing a first maize plant or plant part with a second maize plant or plant part to produce a progeny maize plant or plant part, wherein said first maize plant or plant part comprises within its genome a marker associated with increased male fertility, optionally wherein said second maize plant or plant part lacks said marker, and wherein said progeny maize plant or plant part has said marker within its genome. Such methods may further comprise selecting said progeny plant based upon the presence of said marker.

In some embodiments, methods of producing a maize plant or plant part having one or more characteristics associated with increased male fertility are provided. Such methods may comprise crossing a first maize plant or plant part with a second maize plant or plant part to produce a progeny maize plant or plant part, wherein said first maize plant or plant part comprises within its genome an allele associated with increased male fertility, optionally wherein said second maize plant or plant part lacks said allele, and wherein said progeny maize plant or plant part has said allele within its genome. Such methods may further comprise selecting said progeny plant based upon the presence of said allele and/or the presence of a marker linked to said allele.

In some embodiments, methods of producing a maize plant or plant part having one or more characteristics associated with increased male fertility are provided. Such methods may comprise crossing a first maize plant or plant part with a second maize plant or plant part to produce a progeny maize plant or plant part, wherein said first maize plant or plant part comprises within its genome a genomic region comprising one or more transgenes associated with increased male fertility, optionally wherein said second maize plant or plant part lacks said genomic region, and wherein said progeny maize plant or plant part has said genomic region within its genome. Such methods may further comprise selecting said progeny plant based upon the presence of said genomic region and/or the presence of a marker linked to said genomic region.

In some embodiments, methods of selecting a maize plant or plant part having one or more characteristics associated with increased male fertility are provided. Such methods may comprise crossing a first maize plant or plant part with a second maize plant or plant part, wherein the first maize plant or plant part comprises a marker associated with increased male fertility and optionally wherein said second maize plant or plant part lacks said marker, and selecting a progeny plant or plant part that possesses said marker.

In some embodiments, methods of selecting a maize plant or plant part having one or more characteristics associated with increased male fertility are provided. Such methods may comprise crossing a first maize plant or plant part with a second maize plant or plant part, wherein the first maize plant or plant part comprises an allele associated with increased male fertility and optionally wherein said second maize plant or plant part lacks said allele, and selecting a progeny plant or plant part that possesses said allele and/or a marker linked to said allele.

In some embodiments, methods of selecting a maize plant or plant part having one or more characteristics associated with increased male fertility are provided. Such methods may comprise crossing a first maize plant or plant part with a second maize plant or plant part, wherein the first maize plant or plant part comprises a genomic region comprising one or more transgenes associated with increased male fertility and optionally wherein said second maize plant or plant part lacks said genomic region, and selecting a progeny plant or plant part that possesses said genomic region and/or a marker linked to said genomic region.

In some embodiments, methods of producing a maize plant or plant part having one or more characteristics associated with increased male fertility are provided. Such methods may comprise crossing a donor maize plant or plant part with a recurrent maize plant or plant part and backcrossing progeny with said recurrent maize plants or plant part for one or more generations, wherein said donor maize plant or plant part comprises within its genome a marker associated with increased male fertility, wherein said recurrent maize plant or plant part optionally lacks said marker, and wherein at least one generation of said progeny are identified and/or selected for backcrossing by detecting the presence of said marker.

In some embodiments, methods of producing a maize plant or plant part having one or more characteristics associated with increased male fertility are provided. Such methods may comprise crossing a donor maize plant or plant part with a recurrent maize plant or plant part and backcrossing progeny with said recurrent maize plants or plant part for one or more generations, wherein said donor maize plant or plant part comprises within its genome an allele associated with increased male fertility, wherein said recurrent maize plant or plant part optionally lacks said allele, and wherein at least one generation of said progeny are identified and/or selected for backcrossing by detecting the presence of said allele and/or the presence of a marker linked to said allele.

In some embodiments, methods of producing a maize plant or plant part having one or more characteristics associated with increased male fertility are provided. Such methods may comprise crossing a donor maize plant or plant part with a recurrent maize plant or plant part and backcrossing progeny with said recurrent maize plants or plant part for one or more generations, wherein said donor maize plant or plant part comprises within its genome a genomic region comprising one or more transgenes associated with increased male fertility, wherein said recurrent maize plant or plant part optionally lacks said genomic, and wherein at least one generation of said progeny are identified and/or selected for backcrossing by detecting the presence of said genomic region and/or the presence of a marker linked to said genomic region.

In embodiments, the invention also provides methods of improving seed production from a maize plant. To illustrate, in representative embodiments, the invention provides a method of improving seed production from a maize plant, comprising: crossing a first maize plant with a second maize plant, wherein said first maize plant comprises within its genome a marker associated with increased male fertility as described herein and said second maize plant optionally lacks said marker, to produce a progeny maize plant comprising said marker; and using a progeny maize plant comprising said marker as a pollenator in a cross with itself or a second maize plant that functions as a seed parent (e.g., crossing said progeny plant comprising said marker with itself, wherein the progeny plant functions as a pollenator and as a seed parent, or crossing said progeny plant comprising with a second maize plant, wherein the progeny plant functions as a pollenator and the second maize plant that functions as a seed parent), thereby improving seed production from the cross as compared with a suitable control cross.

In representative embodiments of the methods of the invention, the marker, allele, haplotype and/or genomic region comprises, consists essentially of or consists of:

(a) one or more markers located within one or more of the chromosomal intervals described in Table 1 or a marker/allele/haplotype/genomic region that maps at 10 cM or less therefrom;

(b) one or more of the desired alleles described in Table 2, Table 8 and/or Table 10, or a marker/allele/haplotype/genomic region that maps at 10 cM or less therefrom;

(c) a haplotype comprising two or more of the desired alleles described in Table 2, Table 8 and/or Table 10, or a marker/allele/haplotype/genomic region that maps at 10 cM or less therefrom;

(d) an allele or haplotype that is in linkage disequilibrium with one or more of the chromosomal intervals described in Table 1 or a marker/allele/haplotype/genomic region that maps at 10 cM or less therefrom;

(e) an allele or haplotype that is in linkage disequilibrium with one or more of the desired alleles described in Table 2, Table 8 and/or Table 10, or a marker/allele/haplotype/genomic region that maps at 10 cM or less therefrom;

(f) an allele or haplotype that is in linkage disequilibrium with a haplotype comprising two or more of the desired alleles described in Table 2, Table 8 and/or Table 10, or a marker/allele/haplotype/genomic region that maps at 10 cM or less therefrom; or (g) any combination of (a) to (f).

In further embodiments of the methods of the invention, the marker/allele/haplotype/genomic region is located within:

(a) chromosomal interval 1 as described in Table 1;
(b) chromosomal interval 2 as described in Table 1;
(c) one or more of chromosomal intervals 3 to 17 as described in Table 1;
(d) one or more of chromosomal interval 18 to 45 as described in Table 1;
(e) one or more of chromosomal intervals 46 to 12743 as described in Table 1;
(f) one or more of chromosomal intervals 12744 to 12749 as described in Table 1;
(g) one or more of chromosomal intervals 12750 to 12755 as described in Table 1;
(h) chromosomal interval 12756 as described in Table 1;
(i) one or more of chromosomal intervals 12757 to 12762 as described in Table 1;
(j) one or more of chromosomal intervals 12763 to 12768 as described in Table 1;
(k) one or more of chromosomal intervals 6 to 9371 as described in Table 1;
(l) chromosomal interval 3 as described in Table 1;
(m) chromosomal interval 13 as described in Table 1;
(n) chromosomal interval 25 as described in Table 1; or
(o) any combination of (a) to (n).

In some embodiments, the marker/allele/haplotype/genomic region comprises, consists essentially of or consists of one or more of the desired alleles:

(a) on chromosome 5 as described in Table 8;
(b) on chromosome 3 as described in Table 8;
(c) on chromosome 7 as described in Table 8;
(d) on chromosome 10 as described in Table 8;
(e) on chromosomes 3 and 5 as described in Table 8;
(f) on chromosomes 5 and 7 as described in Table 8;
(g) on chromosomes 3, 5 and 7 as described in Table 8;
(h) on chromosomes 5 and 10 as described in Table 8;
(i) on chromosomes 3, 5 and 10 as described in Table 8;
(j) any combination of (a) to (i); or
(k) or a marker/allele/haplotype/genomic region that maps at 10 cM or less from any of (a) to (j).

In other representative embodiments, the marker/allele/haplotype/genomic region comprises a haplotype comprising two or more of the desired alleles:

(a) on chromosome 5 (QTL 5.1 and/or QTL 5.2) as described in Table 8;
(b) on chromosome 3 as described in Table 8;
(c) on chromosome 7 as described in Table 8;
(d) on chromosome 10 as described in Table 8;
(e) on chromosomes 3 and 5 as described in Table 8;
(f) on chromosomes 5 and 7 as described in Table 8;
(g) on chromosomes 3, 5 and 7 as described in Table 8;
(h) on chromosomes 5 and 10 as described in Table 8;
(i) on chromosomes 3, 5 and 10 as described in Table 8;

(j) any combination of (a) to (i); or (k) or a marker/allele/haplotype/genomic region that maps at 10 cM or less from any of (a) to (j).

In some embodiments, non-naturally occurring maize plants and plant parts comprising one or more markers, alleles and/or genomic regions associated with increased male fertility (e.g., maize plants and plant identified, selected and/or produced according to methods of the invention) are provided.

In some embodiments, progeny and plant parts derived from maize plants and plant parts comprising one or more markers, alleles and/or genomic regions associated with increased male fertility (e.g., maize plants and plant identified, selected and/or produced according to methods of the invention) are provided.

In some embodiments, isolated and/or purified markers associated with increased male fertility are provided. Such markers may comprise, consist essentially of or consist of one or more of the nucleotide sequences set forth in SEQ ID NOs: 1-350, the reverse complement thereof, or an informative or functional fragment thereof.

In some embodiments, isolated and/or purified quantitative trait loci (QTLs) associated with increased male fertility are provided. Such QTLs may comprise, consist essentially of or consist of one or more of the chromosomal segments described in Table 1.

In some embodiments, amplification products comprising one or more markers, alleles and/or genomic regions associated with increased male fertility are provided. Such amplification products may comprise, consist essentially of or consist of one or more of the nucleotide sequences set forth in SEQ ID NOs: 1 to 350, the reverse complement thereof, or an informative or functional fragment thereof.

In some embodiments, probes (e.g., as described in Table 9) for detecting one or more markers, alleles and/or genomic regions associated with increased male fertility are provided. Such probes may comprise, consist essentially of, or consist of one or more of the nucleotide sequences set forth in SEQ ID NOs: 526 to 613, the reverse complement thereof, or an informative or functional fragment thereof.

The foregoing and other objects and aspects of the present invention are explained in detail in the drawings and specification set forth below.

BRIEF DESCRIPTION OF THE TABLES

Table 1 describes segments of maize chromosomes 1, 3, 4, 5, 6, 7, 8, 9 and 10.

Table 2 describes alleles of interest located on maize chromosome 5.

Table 3 describes proteins of interest encoded by maize chromosome 5, as well as the segments of chromosome 5 that encode those proteins.

Table 4 describes Vip3 proteins and the nucleic acid sequences encoding those proteins.

Table 5 shows that Vip3-induced reductions in male fertility vary across genetic backgrounds.

Table 6 shows the LOD (logarithm of the odds) scores of QTLs (quantitative trait locus) identified using F2 plants from bi-parental crosses of NP2222 (described in U.S. Pat. No. 6,710,233) and NP2276 (described in U.S. Pat. No. 6,706,955) and bi-parental crosses of ID3461 (described in International Patent Application No. WO2009142752) and NP2276.

Table 7 shows the Fertility Index used to score F2 plants from bi-parental crosses of NP2222 and NP2276 and bi-parental crosses of ID3461 and NP2276.

Table 8 describes QTLs associated with increased anther quantity and/or improved anther quality in maize plants expressing a Vip3 protein.

Table 9 describes exemplary nucleic acid probes and primers useful to identify the favorable alleles in the QTLs described in Table 8.

Table 10 describes SNPs present in inbred maize line NP2222 versus line NP2276 across the male fertility-associated QTL intervals in Table 8. Where the alleles differ between the two lines, the NP2222 allele corresponds to the desired (favorable) allele.

Table 11 provides public lines predicted to contain favorable alleles.

BRIEF DESCRIPTION OF THE DRAWINGS

FIG. 1 is a chart comparing anther quantity of Vip3-expressing NP2276 inbred lines grown under varying thermal and moisture conditions.

DETAILED DESCRIPTION

Figure 2:
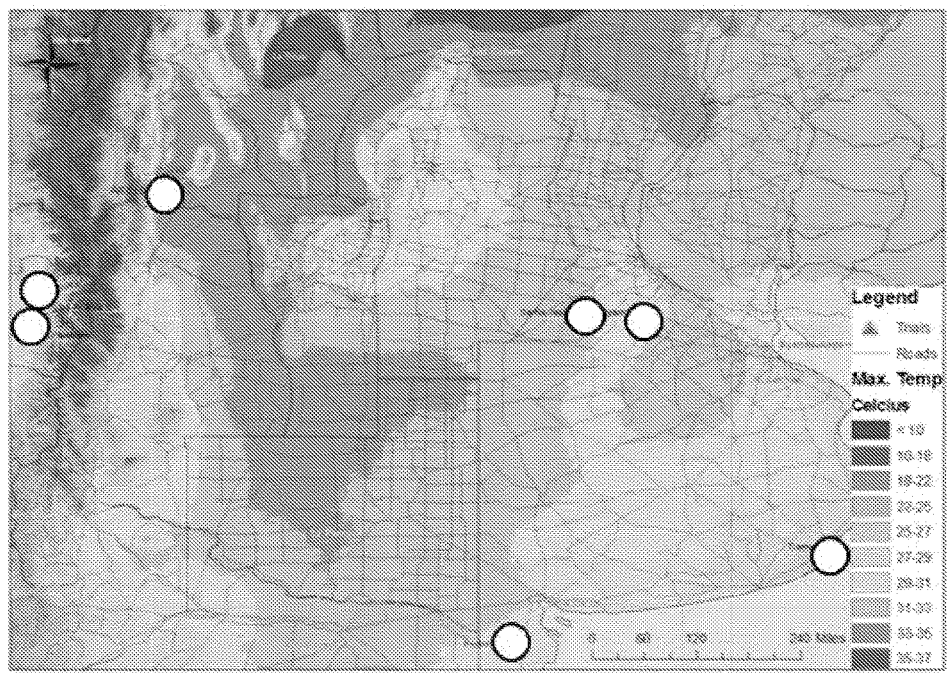
FIG. 2 shows that thermal stress exacerbates Vip3-induced reductions in male fertility.

The present invention provides maize plants having increased fertility, as well as compositions and methods for identifying, selecting and producing maize plants and plant parts having one or more characteristics associated with increased fertility.

Although the following terms are believed to be well understood by one of ordinary skill in the art, the following definitions are set forth to facilitate understanding of the presently disclosed subject matter.

All technical and scientific terms used herein, unless otherwise defined below, are intended to have the same meaning as commonly understood by one of ordinary skill in the art. References to techniques employed herein are intended to refer to the techniques as commonly understood in the art, including variations on those techniques or substitutions of equivalent techniques that would be apparent to one of skill in the art.

All patents, patent publications, non-patent publications and sequences referenced herein are incorporated by reference in their entireties.

Unless otherwise specified, genetic loci are described herein with respect to their positions in the Maize B73 Ref Gen_v2 reference genome (available at www.maizegdb.org). Unless otherwise specified, nucleotides are described herein using the following standard abbreviations: adenine (A), cytosine (C), thymine (T), guanine (G), uracil (U), adenine or guanine (R), cytosine or thymine/uracil (Y), adenine or cytosine (M), guanine or thymine/uracil (K), guanine or cytosine (S), adenine or thymine/uracil (W), guanine or cytosine or thymine/uracil (B), adenine or guanine or thymine/uracil (D), adenine or cytosine or thymine/uracil (H), adenine or guanine or cytosine (V) and adenine or guanine or cytosine or thymine/uracil (N).

Unless otherwise specified, amino acids are described herein using the following standard abbreviations: alanine (Ala; A), arginine (Arg; R), asparagine (Asn; N), aspartic acid (Asp; D), cysteine (Cys; C), glutamine (Gln; Q), glutamic acid (Glu; E), glycine (Gly; G), histidine (His; H), isoleucine (Ile; I), leucine (Leu; L), lysine (Lys; K), methionine (Met; M), phenylalanine (Phe; F), proline (Pro; P), serine (Ser; S), threonine (Thr; T), tryptophan (Trp; W), tyrosine (Tyr; Y), and valine (Val; V).

As used herein, the terms "a" or "an" or "the" may refer to one or more than one. For example, "a" marker can mean one marker or a plurality of markers.

As used herein, the term "and/or" refers to and encompasses any and all possible combinations of one or more of the associated listed items, as well as the lack of combinations when interpreted in the alternative ("or").

As used herein, the term "about," when used in reference to a measurable value such as an amount of mass, dose, time, temperature, and the like, is meant to encompass variations of 20%, 10%, 5%, 1%, 0.5%, or even 0.1% of the specified amount.

As used herein, the term "allele" refers to one of two or more different nucleotides or nucleotide sequences (or the absence thereof) that occur at a specific locus or set of contiguous loci. In some embodiments, the term "allele" may be used interchangeably with the term "marker."

As used herein, the terms "allele of interest," "desired allele" and "favorable allele" are used interchangeably to refer to an allele that is linked to a desired trait. An "allele of interest" may be associated with either an increase or decrease of or in a given trait, depending on the nature of the desired phenotype, and may be associated with a change in morphology, color, etc. In some embodiments of the present invention, the "allele of interest" is associated with increased male fertility and may therefore be used as a marker to identify, select and/or produce fertile maize plants; to predict whether and/or to what extent a maize plant will be fertile; to reduce the costs associated with breeding and/or seed production programs; and/or to increase the efficiency of breeding and/or seed production programs.

As used herein, the terms "backcross" and "backcrossing" refer to the process whereby a progeny plant is crossed back to one of its parents for one or more generations (e.g., 2 or more, 3 or more, 4 or more, 5 or more, 6 or more, or 7 or more times, etc.). In a backcrossing scheme, the "donor" parent refers to the parental plant with the desired gene or locus to be introgressed. The "recipient" parent (used one or more times) or "recurrent" parent (used two or more times) refers to the parental plant into which the gene or locus is being introgressed. For example, see Ragot et al. *Marker-assisted Backcrossing: A Practical Example*, in TECHNIQUES ET UTILISATIONS DES MARQUEURS MOLECULAIRES LES COLLOQUES, Vol. 72, pp. 45-56 (1995); and Openshaw et al., *Marker-assisted Selection in Backcross Breeding*, in PROCEEDINGS OF THE SYMPOSIUM "ANALYSIS OF MOLECULAR MARKER DATA," pp. 41-43 (1994). The initial cross gives rise to the F1 generation. The term "BC1" refers to the second use of the recurrent parent, "BC2" refers to the third use of the recurrent parent, and so on. In embodiments, at least one or more generations of progeny are identified and/or selected for the presence of the desired gene or locus (e.g., in a nucleic acid sample from the progeny plant or plant part). In embodiments, two or more generations (or even all generations) of progeny are identified and/or selected for the presence of the desired gene or locus.

As used herein, the term "closely linked loci" refers to genetic loci that display an inter-locus recombination frequency of about 10%, 9%, 8%, 7%, 6%, 5%, 4%, 3%, 2%, 1%, 0.75%, 0.5%, 0.25% or less. Since one cM equals the distance between two loci that show a 1% recombination frequency, closely linked loci on the same chromosome will reside at about 10, 9, 8, 7, 6, 5, 4, 3, 2, 1, 0.75, 0.5 or 0.25 cM or less from another. Such loci may be said to be "proximal to" one another.

As used herein, the terms "centimorgan" and "cM" refer to a unit of measure of recombination frequency. One cM is equal to a 1% chance that a marker at one genetic locus will be separated from a marker at a second locus due to crossing over in a single generation.

As used herein, the term "coding sequence" refers to a nucleic acid sequence that is transcribed into RNA such as mRNA, rRNA, tRNA, snRNA, shRNA, sense RNA or antisense RNA. The RNA may be translated to produce a polypeptide.

As used herein, the term "completely fertile" refers to a plant that is at least as fertile as a control plant (e.g., one or both of its parents, a near isogenic plant that lacks one or more markers/alleles associated with increased fertility, a near isogenic plant that lacks a vip3 coding sequence, etc.). In some embodiments, "completely fertile" plants release at least as many pollen grains per tassel per day in the three-day period immediately following anther extrusion as the control plant. In some embodiments, "completely fertile" plants release more pollen grains per tassel per day in the three-day period immediately following anther extrusion than the control plant.

As used herein, the terms "cross" or "crossed" refer to the fusion of gametes via pollination to produce progeny (e.g., cells, seeds or plants). The term encompasses both sexual crosses (the pollination of one plant by another) and selfing (self-pollination, e.g., when the pollen and ovule are from the same plant). The term "crossing" refers to the act of fusing gametes via pollination to produce progeny.

As used herein, the terms "cultivar" and "variety" refer to a group of similar plants that by structural or genetic features and/or performance can be distinguished from other varieties within the same species.

As used herein, the term "cultivated" refers to a plant that is no longer in the natural state, but has been developed and domesticated by human care and for agricultural use and/or human consumption. "Cultivated" plants, as used herein, excludes native plants that comprise the subject trait of this invention as a natural trait and/or as part of its natural genetics.

As used herein, the terms "decrease," "decreases," "decreasing" and similar terms refer to a reduction of at least about 5%, 10%, 15%, 20%, 25%, 30%, 35%, 40%, 45%, 50%, 55%, 60%, 65%, 70%, 75%, 80%, 85%, 90%, 95%, 96%, 97%, 98%, 99% or more. In some embodiments, the reduction results in no or essentially no activity (i.e., an insignificant or undetectable amount of activity).

As used herein, the terms "elite" and "elite line" refer to any line that has resulted from breeding and selection for desirable agronomic performance. An elite line may be substantially homozygous. Numerous elite lines are available and known to those of skill in the art.

As used herein, the term "elite germplasm" refers to any germplasm that is derived from or is capable of giving rise to an elite plant.

As used herein, the term "event" refers to a particular transformant. In a typical transgenic breeding program, a transformation construct responsible for a trait is introduced into the genome via a transformation method. Numerous independent transformants (events) are usually generated for each construct. These events are evaluated to select those with superior performance.

As used herein, with respect to nucleic acids, the term "exogenous" refers to a nucleic acid that is not in the natural genetic background of the cell/organism in which it resides. In some embodiments, the exogenous nucleic acid comprises one or more nucleic acid sequences that are not found in the natural genetic background of the cell/organism. In some embodiments, the exogenous nucleic acid comprises one or more additional copies of a nucleic acid that is endogenous to the cell/organism.

As used herein, the term "expression cassette" refers to a nucleotide capable of directing expression of a particular nucleic acid sequence in a host cell (e.g., a maize cell). In some embodiments, the expression cassette comprises, consists essentially of or consists of one or more promoter sequences (e.g., one or more constitutive/inducible promoter sequences, one or more tissue- and/or organ-specific promoter sequences and/or one or more developmental stage-specific promoter sequences) operably linked to a nucleic acid of interest, which is operably linked to a termination sequence. Expression cassettes often comprise sequences required for proper translation of the nucleic acid sequence of interest in the host cell. The expression cassette may be chimeric in that at least one of its components is heterologous with respect to at least one of its other components. The expression cassette may be one that is naturally occurring but that has been obtained in a recombinant form useful for heterologous expression. Typically, however, the expression cassette is heterologous with respect to the host (i.e., the particular nucleic acid sequence of the expression cassette does not occur naturally in the host cell and must have been introduced into the host cell or an ancestor of the host cell by a transformation event).

As used herein with respect to nucleic acids, the term "fragment" refers to a nucleic acid that is reduced in length relative to a reference nucleic acid and that comprises, consists essentially of and/or consists of a nucleotide sequence of contiguous nucleotides identical or almost identical (e.g., 90%, 91%, 92%, 93%, 94%, 95%, 96%, 97%, 98%, 99% identical) to a corresponding portion of the reference nucleic acid. Such a nucleic acid fragment may be, where appropriate, included in a larger polynucleotide of which it is a constituent. In some embodiments, the nucleic acid fragment comprises, consists essentially of or consists of at least about 5, 6, 7, 8, 9, 10, 11, 12, 13, 14, 15, 20, 25, 30, 35, 40, 45, 50, 55, 60, 65, 70, 75, 80, 85, 90, 95, 100, 125, 150, 175, 200, 225, 250, 300, 350, 400, 450, 500, or more consecutive nucleotides. In some embodiments, the nucleic acid fragment comprises, consists essentially of or consists of less than about 5, 6, 7, 8, 9, 10, 11, 12, 13, 14, 15, 20, 25, 30, 35, 40, 45, 50, 55, 60, 65, 70, 75, 80, 85, 90, 95, 100, 125, 150, 175, 200, 225, 250, 300, 350, 400, 450 or 500 consecutive nucleotides.

As used herein with respect to polypeptides, the term "fragment" refers to a polypeptide that is reduced in length relative to a reference polypeptide and that comprises, consists essentially of and/or consists of an amino acid sequence of contiguous amino acids identical or almost identical (e.g., 90%, 91%, 92%, 93%, 94%, 95%, 96%, 97%, 98%, 99% identical) to a corresponding portion of the reference polypeptide. Such a polypeptide fragment may be, where appropriate, included in a larger polypeptide of which it is a constituent. In some embodiments, the polypeptide fragment comprises, consists essentially of or consists of at least about 2, 3, 4, 5, 6, 7, 8, 9, 10, 11, 12, 13, 14, 15, 20, 25, 30, 35, 40, 45, 50, 55, 60, 65, 70, 75, 80, 85, 90, 95, 100, 125, 150, 175, 200, 225, 250, 300, 350, 400, 450, 500, or more consecutive amino acids. In some embodiments, the polypeptide fragment comprises, consists essentially of or consists of less than about 2, 3, 4, 5, 6, 7, 8, 9, 10, 11, 12, 13, 14, 15, 20, 25, 30, 35, 40, 45, 50, 55, 60, 65, 70, 75, 80, 85, 90, 95, 100, 125, 150, 175, 200, 225, 250, 300, 350, 400, 450 or 500 consecutive amino acids.

As used herein with respect to nucleic acids, the term "functional fragment" refers to nucleic acid that encodes a functional fragment of a polypeptide.

As used herein with respect to polypeptides, the term "functional fragment" refers to polypeptide fragment that retains at least about 20%, 25%, 30%, 35%, 40%, 45%, 50%, 55%, 60%, 65%, 70%, 75%, 80%, 85%, 90%, 95%, 96%, 97%, 98%, 99% or more of at least one biological activity of the full-length polypeptide (e.g., the ability to convert all-trans-$\beta$-carotene into 9-cis-$\beta$-carotene). In some embodiments, the functional fragment actually has a higher level of at least one biological activity of the full-length polypeptide.

As used herein, the terms "fertile" and "functionally fertile" are used interchangeably and refer to a plant that is fertile enough for use in a breeding and/or seed production program. In some embodiments, "functionally fertile" plants are plants that release at least about 100,000; 150,000; 200,000; 250,000; 300,000, 350,000, 400,000 or 450,000 pollen grains per tassel per day in the three-day period immediately following anther extrusion.

As used herein, the term "gene product" refers to a material resulting from expression of a nucleic acid. In some embodiments, the gene product is an RNA molecule (e.g., an mRNA molecule or an antisense RNA molecule). In some embodiments, the gene product is a polypeptide.

As used herein, the term "genetic map" refers to a description of genetic linkage relationships among loci on one or more chromosomes within a given species, generally depicted in a diagrammatic or tabular form. For each genetic map, distances between loci are measured by the recombination frequencies between them. Recombinations between loci can be detected using a variety of markers. A genetic map is a product of the mapping population, types of markers used, and the polymorphic potential of each marker between different populations. The order and genetic distances between loci can differ from one genetic map to another.

As used herein, the term "genetic marker" refers to one or more nucleotides associated with a phenotype, trait or trait form of interest. In some embodiments, a marker may be associated with an allele or alleles of interest and may be indicative of the presence or absence of the allele or alleles of interest in a cell or organism. In some embodiments, the marker may comprise, consist essentially of, or consist of an allele or alleles of interest. A marker may be, but is not limited to, an allele, a haplotype, a restriction fragment length polymorphism (RFLP), a simple sequence repeat (SSR), random amplified polymorphic DNA (RAPD), cleaved amplified polymorphic sequences (CAPS) (Rafalski and Tingey, *Trends in Genetics* 9:275 (1993)), an amplified fragment length polymorphism (AFLP) (Vos et al., *Nucleic Acids Res.* 23:4407 (1995)), a single nucleotide polymorphism (SNP) (Brookes, *Gene* 234:177 (1993)), a sequence-characterized amplified region (SCAR) (Paran and Michehnore, *Theor. Appl. Genet.* 85:985 (1993)), a sequence-tagged site (STS) (Onozaki et al., *Euphytica* 138:255 (2004)), a single-stranded conformation polymorphism (SSCP) (Orita et al., *Proc. Natl. Acad. Sci. USA* 86:2766 (1989)), an inter-simple sequence repeat (ISSR) (Blair et al., *Theor. Appl. Genet.* 98:780 (1999)), an inter-retrotransposon amplified polymorphism (IRAP), a retrotransposon-microsatellite amplified polymorphism (REMAP) (Kalendar et al., *Theor. Appl. Genet.* 98:704 (1999)) or an RNA cleavage product (such as a Lynx tag). A marker may be present in genomic or expressed nucleic acids (e.g., ESTs). Some of the markers described herein are also referred to as hybridization markers when located on an indel region. This is because the insertion region is, by definition, a polymorphism vis-à-vis a plant without the insertion. Thus, the marker need only indicate whether the indel region is present or absent. Any suitable marker detection technology may be used to identify such a hybridization marker, e.g., SNP technology is used in the examples provided herein. A large number of maize genetic markers are known in the art, and are published or available from various sources, such as the Maize GDB internet resource and the Arizona Genomics Institute internet resource run by the University of Arizona.

As will be understood by those skilled in the art, "genetic markers" may comprise "dominant" and/or "codominant" markers. "Codominant markers" reveal the presence of two or more alleles (two per diploid individual). "Dominant markers" reveal the presence of only a single allele. The presence of the dominant marker phenotype (e.g., a band of DNA) is an indication that one allele is present in either the homozygous or heterozygous condition. In the case of populations where individuals are predominantly homozygous and loci are predominantly dimorphic, dominant and codominant markers can be equally valuable. As populations become more heterozygous and multiallelic, codominant markers often become more informative of the genotype than dominant markers.

As used herein, the term "genotype" refers to the genetic constitution of an individual (or group of individuals) at one or more genetic loci, as contrasted with the observable and/or detectable and/or manifested trait (the phenotype). Genotype is defined by the allele(s) of one or more known loci that the individual has inherited from its parents. The term genotype can be used to refer to an individual's genetic constitution at a single locus, at multiple loci, or more generally, the term genotype can be used to refer to an individual's genetic make-up for all the genes in its genome. Genotypes can be indirectly characterized, e.g., using markers and/or directly characterized by nucleic acid sequencing.

As used herein, the term "germplasm" refers to genetic material of or from an individual plant, a group of plants (e.g., a plant line, variety or family), or a clone derived from a plant line, variety, species, or culture. The genetic material can be part of a cell, tissue or organism, or can be isolated from a cell, tissue or organism.

As used herein, the term "haplotype" refers to a combination of alleles (two or more) at a plurality of genetic loci. Typically, the genetic loci that define a haplotype are physically and genetically linked (i.e., the alleles that make up a haplotype are generally located on the same chromosome segment). Thus, in some embodiments, the term "haplotype" refers to a plurality of alleles within a single chromosomal segment or to a plurality of alleles within two or more chromosomal segments residing on the same chromosome.

As used herein, the terms "haplotype of interest" and "desired haplotype" are used interchangeably to refer to a haplotype that is linked to a desired trait. A "haplotype of interest" may be associated with either an increase or decrease of or in a given trait, depending on the nature of the trait, and may be associated with a change in morphology, color, etc. In some embodiments of the present invention, the "haplotype of interest" is associated with increased male fertility and may therefore be used as a marker to identify, select and/or produce fertile maize plants; to predict whether and/or to what extent a maize plant will be fertile; to reduce the costs associated with breeding and/or seed production programs; and/or to increase the efficiency of breeding and/or seed production programs.

As used herein, the term "hemizygous" refers to a genetic status in a diploid cell in which there is only one copy of a gene instead of the typical two copies (i.e., the gene has no counterpart on a homologous chromosome). For example, in mammals, the genes on the X chromosome are hemizygous in males. As another illustration, a heterologous transgene can be present in a hemizygous state.

As used herein, the term "heterologous" refers to a nucleotide/polypeptide that originates from a foreign species, or, if from the same species, is substantially modified from its native form in composition and/or genomic locus by deliberate human intervention.

As used herein, the term "heterotic group" refers to a set of genotypes that display similar heterotic response when crossed with genetically distinct groups of genotypes (i.e., when crossed with genotypes from a different heterotic grou4p). Hallauer et al., Corn breeding, in CORN AND CORN IMPROVEMENT p. 463-564 (1998). Inbred lines are classified into heterotic groups, and are further subdivided into families within a heterotic group, based on several criteria such as pedigree, molecular marker-based associations, and performance in hybrid combinations. Smith et al., *Theor. Appl. Gen.* 80:833 (1990). The "Stiff Stalk" heterotic group represents a major heterotic group in the northern U.S. and Canadian corn growing regions; it is sometimes referred to as the "Iowa Stiff Stalk Synthetic" or "BSSS" heterotic group. The "non-Stiff Stalk" heterotic group represents a major heterotic group in the northern U.S. and Canadian corn growing regions; it is sometimes referred to as the "Lancaster" or "Lancaster Sure Crop" heterotic group.

As used herein, the term "heterozygous" refers to a genetic status wherein different alleles reside at corresponding loci on homologous chromosomes.

As used herein, the term "homozygous" refers to a genetic status wherein identical alleles reside at corresponding loci on homologous chromosomes.

As used herein, the term "hybrid" refers to a plant or plant part produced when at least two genetically dissimilar parents are crossed. Without limitation, examples of mating schemes include single crosses, modified single crosses, double modified single crosses, three-way crosses, modified three-way crosses, and double crosses, wherein at least one parent in a modified cross is the progeny of a cross between sister lines.

As used herein, the term "inbred" refers to a substantially homozygous plant or variety. The term may refer to a plant or variety that is substantially homozygous throughout the entire genome or that is substantially homozygous with respect to a portion of the genome that is of particular interest. Without limitation, examples of breeding methods to derive inbreds include pedigree breeding, recurrent selection, single-seed descent, backcrossing, and doubled haploids.

As used herein, the terms "increase," "increases," "increasing" and similar terms refer to an augmentation of at least about 5%, 10%, 15%, 20%, 25%, 30%, 35%, 40%, 45%, 50%, 55%, 60%, 65%, 70%, 75%, 80%, 85%, 90%, 95%, 100%, 125%, 150%, 175%, 200%, 300% or more.

As used herein, the term "increased fertility" refers to an improvement in one or more fertility traits as compared to one or more controls (e.g., a native plant/germplasm of the same species, one or both parents, a near isogenic plant that lacks one or more markers/alleles associated with increased fertility, a near isogenic plant that lacks a vip3 coding sequence, etc.). Exemplary fertility traits include, but are not limited to, pollen count, pollen morphology, pollen production per anther, anther count, anther morphology, anthers per tassel, tassel count, tassel morphology, tassels per plant, silk count, silk morphology, silk production per plant, kernel count, kernel morphology, kernel production per ear, prevalence of kernel abortion, kernel production per plant and kernel viability. Thus, a plant that exhibits increased pollen production, increased pollen production per anther, improved pollen morphology, increased anther production, increased anther production per tassel, improved anther morphology, increased tassel production, improved tassel morphology, increased silk production, improved silk morphology, increased silk production per plant, increased kernel count, improved kernel morphology, increased kernel production per ear, decreased prevalence of kernel abortion, increased kernel production per plant, increased kernel viability, increased fertility under stress conditions (e.g., drought conditions), increased fertility under elevated daytime temperatures and/or increased fertility under elevated nighttime temperatures as compared to a control plant (e.g., a native plant/germplasm of the same species, one or both parents, a near isogenic plant that lacks one or more markers/alleles associated with increased fertility, a near isogenic plant that lacks a vip3 coding sequence, etc.) displays increased fertility. When used in reference to a plant part (e.g., a germplasm), the term "increased fertility" refers to an improvement in one or more fertility traits in a plant that arises from that plant part.

As used herein, the term "increased female fertility" refers to an improvement in one or more female fertility traits as compared to one or more controls (e.g., a native plant/germplasm of the same species, one or both parents, a near isogenic plant that lacks one or more markers/alleles associated with increased fertility, a near isogenic plant that lacks a vip3 coding sequence, etc.). Exemplary female fertility traits include, but are not limited to, silk count, silk morphology, silk production per plant, kernel count, kernel morphology, kernel production per ear, prevalence of kernel abortion, kernel production per plant and kernel viability. Thus, a plant that exhibits increased silk production, improved silk morphology, increased silk production per plant, increased kernel count, improved kernel morphology, increased kernel production per ear, decreased prevalence of kernel abortion, increased kernel production per plant, increased kernel viability, increased female fertility under stress conditions (e.g., drought conditions), increased female fertility under elevated daytime temperatures and/or increased female fertility under elevated nighttime temperatures as compared to a control plant (e.g., a native plant/germplasm of the same species, one or both parents, a near isogenic plant that lacks one or more markers/alleles associated with increased fertility, a near isogenic plant that lacks a vip3 coding sequence, etc.) displays increased female fertility. When used in reference to a plant part (e.g., a germplasm), the term "increased female fertility" refers to an improvement in one or more female fertility traits in a plant that arises from that plant part.

As used herein, the term "increased male fertility" refers to an improvement in one or more male fertility traits as compared to one or more controls (e.g., a native plant/germplasm of the same species; one or both parents, a near isogenic plant that lacks one or more markers/alleles associated with increased fertility, a near isogenic plant that lacks a vip3 coding sequence, etc.). Exemplary male fertility traits include, but are not limited to, pollen count, pollen morphology, pollen production per anther, anther count, anther morphology, anthers per tassel, tassel count, tassel morphology and tassels per plant. Thus, a plant that exhibits increased pollen production, increased pollen production per anther, improved pollen morphology, increased anther production, increased anther production per tassel, improved anther morphology, increased tassel production, improved tassel morphology, increased male fertility under stress conditions (e.g., drought conditions), increased male fertility under elevated daytime temperatures and/or increased male fertility under elevated nighttime temperatures as compared to a control plant (e.g., a native plant/germplasm of the same species, one or both parents, a near isogenic plant that lacks one or more markers/alleles associated with increased fertility, a near isogenic plant that lacks a vip3 coding sequence, etc.). displays increased male fertility. When used in reference to a plant part (e.g., a germplasm), the term "increased male fertility" refers to an improvement in one or more male fertility traits in a plant that arises from that plant part.

As used herein, the term "indel" refers to an insertion or deletion in a pair of nucleotide sequences, wherein a first sequence may be referred to as having an insertion relative to a second sequence or the second sequence may be referred to as having a deletion relative to the first sequence.

As used herein, the term "infertile" refers to a plant that is insufficiently fertile for use in a breeding program. In some embodiments, "infertile" plants are plants that release fewer than 25,000; 50,000; 75,000 or 100,000 pollen grains per tassel per day in the three-day period immediately following anther extrusion. "Infertile" plants may produce and/or release viable pollen grains. Indeed, in some embodiments, "infertile" plants produce and release viable pollen grains, but do so a rate that is insufficient for effective use in a breeding and/or seed production program.

As used herein, the term "informative fragment" refers to a nucleotide sequence comprising a fragment of a larger nucleotide sequence, wherein the fragment allows for the identification of one or more alleles within the larger nucleotide sequence. For example, an informative fragment of the nucleotide sequence of SEQ ID NO: 1 comprises a fragment of the nucleotide sequence of SEQ ID NO: 1 and allows for the identification of one or more alleles of interest located within the portion of the nucleotide sequence corresponding to that fragment of SEQ ID NO: 1.

As used herein, the terms "introgression," "introgressing" and "introgressed" refer to both the natural and artificial transmission of a desired allele or combination of desired alleles of a genetic locus or genetic loci from one genetic background to another. For example, a desired allele at a specified locus can be transmitted to at least one progeny via a sexual cross between two parents of the same species, where at least one of the parents has the desired allele in its genome. Alternatively, for example, transmission of an allele can occur by recombination between two donor genomes, e.g., in a fused protoplast, where at least one of the donor protoplasts has the desired allele in its genome. The desired allele may be a selected allele of a marker, a QTL, a transgene, or the like. Offspring comprising the desired allele can be repeatedly backcrossed to a line having a desired genetic background and selected for the desired allele, with the result being that the desired allele becomes fixed in the desired genetic background. For example, a marker associated with increased fertility may be introgressed from a donor into a recurrent parent that is not functionally fertile. The resulting offspring could then be repeatedly backcrossed and selected until the progeny possess the enhanced fertility allele in the recurrent parent background.

As used herein with respect to nucleotides and polypeptides, the term "isolated" refers to a nucleotide or polypeptide that is substantially free of cellular material, viral material, culture medium (when produced by recombinant DNA techniques), or chemical precursors or other chemicals (when chemically synthesized). An "isolated fragment" is a fragment of a nucleotide or polypeptide that is not naturally occurring as a fragment and would not be found in the natural state. "Isolated" does not mean that the preparation is technically pure (homogeneous), but rather that it is sufficiently pure to provide the nucleotide or polypeptide in a form in which it can be used for the intended purpose. In certain embodiments, the composition comprising the nucleotide or polypeptide is at least about 50%, 55%, 60%, 65%, 70%, 75%, 80%, 85%, 90%, 95%, 96%, 97%, 98%, or 99% or more pure.

As used herein with respect to cells, the term "isolated" refers to a cell that is separated from other components with which it is normally associated in its natural state. For example, an isolated plant cell may be a plant cell in culture medium and/or a plant cell in a suitable carrier. "Isolated" does not mean that the preparation is technically pure (homogeneous), but rather that it is sufficiently pure to provide the cell in a form in which it can be used for the intended purpose. In certain embodiments, the composition comprising the cell is at least about 50%, 55%, 60%, 65%, 70%, 75%, 80%, 85%, 90%, 95%, 96%, 97%, 98%, or 99% or more pure.

As used herein, the term "linkage" refers to the degree to which a marker is associated with a given allele and/or phenotypic trait (e.g., increased male fertility). The more closely a marker is linked to an allele/phenotype, the better an indicator that marker becomes. The degree of linkage between a marker and a phenotypic trait may be measured and expressed as the statistical probability of cosegregation of the marker and phenotypic trait. The linkage relationship between a marker and an allele/phenotype may be given as a "probability" or "adjusted probability." Linkage can be expressed as a desired limit or range. For example, in some embodiments, two genetic markers are deemed to be linked if they are separated by less than about 50, 40, 30, 25, 20, 15, 10, 5, 4, 3, 2, or 1 cM. In representative embodiments, two genetic markers are linked if they are separated by 10 cM or less.

As used herein, the term "linkage disequilibrium" refers to a non-random segregation of genetic loci or traits (or both). Linkage disequilibrium implies that the relevant loci are within sufficient physical proximity along a length of a chromosome so that they segregate together with greater than random (i.e., non-random) frequency. Markers/alleles that show linkage disequilibrium are considered linked. Linked markers/alleles co-segregate more than 50% of the time. In other words, markers/alleles that co-segregate have a recombination frequency of less than 50%. Linkage disequilibrium is most commonly assessed using the measure $r^2$, which is calculated using the formula described by Hill and Robertson, *Theor. Appl. Genet.* 38:226 (1968). When $r^2=1$, complete linkage disequilibrium exists between the markers/alleles, meaning that the markers have not been separated by recombination and have the same allele frequency. Values for $r^2$ above ⅓ generally indicate sufficiently strong linkage disequilibrium to be useful for mapping. Ardlie et al., *Nature Reviews Genetics* 3:299 (2002). Hence, in some embodiments, markers/alleles are said to be in linkage disequilibrium when $r^2$ values between pairwise marker loci are greater than or equal to about 0.33, 0.4, 0.5, 0.6, 0.7, 0.8, 0.9, or 1.0.

As used herein, the term "linkage equilibrium" describes a situation where markers/alleles independently segregate (i.e., sort among progeny randomly). Markers that show linkage equilibrium are considered unlinked (whether or not they lie on the same chromosome).

As used herein, the term "linkage group" refers to a group of genes associated together by linkage relationships.

As used herein, the term "locus" refers to a position on a chromosome. Loci may encompass one or more nucleotides.

As used here, the terms "logarithm of odds" and "LOD score" refer to the likelihood that two genetic loci are linked. LOD scores are most commonly assessed using the measure Z, which is equal to the logarithm of the ratio of the likelihood that the genetic loci are linked and 0.5 times the likelihood that the two genetic loci are independently sorted. Positive LOD scores are indicative of linkage, whereas negative LOD scores are indicative of independent assortment. LOD scores of 2.5 and higher generally sufficiently strong linkage to be useful for mapping. Hence, in some embodiments, markers/alleles are said to be linked when the LOD score is greater than or equal to about 2, 2.5, 3, 3.5, 4, 4.5, 5, 5.5, 6, 6.5, 7, 7.5, 8, 8.5, 9, 9.5, 10, 11, 12, 13, 14, 15, 16, 17, 18, 19, 20 or more.

As used herein, the term "maize" refers to *Zea mays* L. subsp. *mays*. In some embodiments, the maize plant or plant part is from the group *Zea mays* L. subsp. *mays* Identata, sometimes referred to as dent corn. In some embodiments, the maize plant or plant part is from the group *Zea mays* L. subsp. *mays* Indurata, sometimes referred to as flint corn. In some embodiments, the maize plant or plant part is from the group *Zea mays* L. subsp. *mays* Saccharata, sometimes referred to as sweet corn. In some embodiments, the maize plant or plant part is from the group *Zea mays* L. subsp. *mays* Amylacea, sometimes referred to as flour corn. In some embodiments, the maize plant or plant part is from the group *Zea mays* L. subsp. *mays* Everts, sometimes referred to as pop corn. Maize plants that can be identified selected and/or produced with methods and compositions of the present invention include hybrids, inbreds, partial inbreds, members of defined populations and members of undefined populations.

As used herein, the terms "male fertile" and "male fertility" refer to the ability of a plant to produced and release viable, functional pollen grains.

As used herein, the terms "male sterile" and "male sterility" refer to the inability of a plant to produce and/or release viable, functional pollen grains. Male sterility generally occurs as a result of failure of formation or development of functional stamens, microspores or gametes. Typically there are three types of male sterility: 1) "pollen sterility" in which male sterile individuals differ from normal only in the absence or extreme scarcity of functional pollen grains; 2) "structural or staminal male sterility" in which male flowers or stamen are malformed and non-functional or completely absent; and 3) "functional male sterility" in which perfectly good and viable pollen is trapped in indehiscent anther and thus prevented from functioning.

As used herein, the term "marker" refers to a detectable characteristic that can be used to discriminate between organisms. Examples of such characteristics may include genetic composition (e.g., genetic marker), gene expression levels, protein composition, protein levels, oil composition, oil levels, carbohydrate composition, carbohydrate levels, fatty acid composition, fatty acid levels, amino acid composition, amino acid levels, biopolymers, pharmaceutical, starch composition, starch levels, fermentable starch, fermentation yield, fermentation efficiency, energy yield, secondary compounds, metabolites, morphological characteristics, and agronomic characteristics.

A marker is "associated with" a trait when it is linked to it and when the presence of the marker is an indicator of whether and/or to what extent the desired trait or trait form will occur in a plant/plant part comprising the marker. Similarly, a marker is "associated with" an allele when it is linked to it and when the presence of the marker is an indicator of whether the allele is present in a plant/plant part comprising the marker. For example, "a marker associated with increased male fertility" refers to a marker whose presence or absence can be used to predict whether and/or to what extent a plant/plant part will display increased male fertility.

Markers corresponding to genetic polymorphisms between members of a population can be detected by methods well-established in the art. These include, e.g., nucleic acid sequencing, hybridization methods, amplification methods (e.g., PCR-based sequence specific amplification methods), detection of restriction fragment length polymorphisms (RFLP), detection of isozyme markers, detection of polynucleotide polymorphisms by allele specific hybridization (ASH), detection of amplified variable sequences of the plant genome, detection of self-sustained sequence replication, detection of simple sequence repeats (SSRs), detection of single nucleotide polymorphisms (SNPs), and/or detection of amplified fragment length polymorphisms (AFLPs). Well established methods are also known for the detection of expressed sequence tags (ESTs) and SSR markers derived from EST sequences and randomly amplified polymorphic DNA (RAPD).

As used herein, the terms "marker allele" and "allele of a marker locus" refer to one of a plurality of polymorphic nucleotides or nucleotide sequences found at a marker locus in a population that is polymorphic for the marker locus.

As used herein, the term "marker locus" refers to a specific chromosome location in the genome of an organism where a specific marker can be found. A marker locus can be used to track the presence of a second linked locus, e.g., a linked locus that encodes or contributes to expression of a phenotypic trait. For example, a marker locus can be used to monitor segregation of alleles at a locus, such as a QTL or single gene, that are genetically or physically linked to the marker locus.

As used herein, the terms "marker probe" and "probe" refer to a molecule that can be used to detect the presence of one or more particular alleles, haplotypes and/or molecules of interest. In some embodiments, a "marker probe" is a nucleic acid sequence that is complementary to all of or a portion of an allele of interest. Marker probes (as described in Table 9) comprising 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more contiguous nucleotides may be used for nucleic acid hybridization. In some embodiments, the marker probe comprises at least about 7, 10, 15, 20, 25, 30, 35, 40, 45, 50, 55, 60, 65, 70, 75, 80, 85, 90, 95, 100, 125, 150, 175, 200 or more contiguous nucleotides. In some embodiments, the marker probe may be used to distinguish (i.e., genotype) the particular allele that is present at a marker locus.

As used herein, the terms "marker-assisted selection" and "MAS" refer to a process by which phenotypes are indirectly selected based on marker genotypes. MAS can optionally be supplemented by direct phenotyping of the trait of interest. For example, when MAS is used for breeding, phenotyping can be done at one or more points in the process to confirm that the individuals or their progeny express the phenotype of interest.

As used herein, the term "marker-assisted counter-selection" refers to a process by which marker genotypes are used to identify plants that will not be selected, allowing them to be removed from a breeding program or planting.

As used herein, the terms "MIR162 plant" and "MIR162 plant part" refer to maize plants/plant parts that comprise the MIR162 event as described in U.S. Pat. No. 8,232,456. The MIR162 plant or MIR162 plant part can be hemizygous or homozygous for the MIR162 event.

As used herein, the term "molecular marker" may be used to refer to a genetic marker, as defined above, or an encoded product thereof (e.g., a protein) used as a point of reference when identifying a linked locus. A molecular marker can be derived from genomic nucleotide sequences or from expressed nucleotide sequences (e.g., from a spliced RNA, a cDNA, etc.). The term also refers to nucleotide sequences complementary to or flanking the marker sequences, such as nucleotide sequences used as probes (as described in Table 9) and/or primers capable of amplifying the marker sequence. Nucleotide sequences are "complementary" when they specifically hybridize in solution, e.g., according to Watson-Crick base pairing rules.

As used herein, the terms "molecule of interest" and "desired molecule" are used interchangeably to refer to a haplotype that is linked to a desired trait. A "molecule of interest" may be associated with either an increase or decrease of or in a given trait, depending on the nature of the desired phenotype, and may be associated with a change in morphology, color, etc. In some embodiments of the present invention, the "molecule of interest" is associated with increased male fertility and may therefore be used as a marker to identify, select and/or produce fertile maize plants; to predict whether and/or to what extent a maize plant will be fertile; to reduce the costs associated with breeding and/or seed production programs; and/or to increase the efficiency of breeding and/or seed production programs.

As used herein with respect to nucleotides, the term "native" refers to a nucleic acid sequence that is naturally present in the genome of a cell or plant.

As used herein with respect to polypeptides, the term "native" refers to an amino acid sequence that is naturally present in the proteome of a cell or plant.

As used herein, the terms "near isogenic line" (NIL) and "near isogenic plant" refer to maize lines/plants that are genetically identical except for one or a few genetic loci. Such lines/plants can be created by crossing a donor line, containing a gene or trait of interest, with a recurrent parent to produce a heterozygous F1, and then repeatedly backcrossing the offspring to the recurrent parent (BC1, BC2, etc), retaining the donor gene or trait in each successive generation. Marker assisted selection (MAS) can be used to increase the efficiency of NIL development by screening individuals for the presence of the target locus (gene) in each generation and the absence of extraneous donor DNA throughout the rest of the genome to speed up the return to recurrent parent type.

As used herein, the term "nonnaturally occurring" refers to a plant or plant part that does not naturally exist in nature. A nonnaturally occurring plant or plant part may be produced by any method known in the art, including, but not limited to, transforming a plant or plant part, transfecting a plant or plant part, and crossing a naturally occurring plant or plant part with a nonnaturally occurring plant or plant part. In some embodiments, the nonnaturally occurring plant or plant part comprises one of more exogenous nucleotide sequences. In some embodiments, the nonnaturally occurring plant or plant part comprises one or more nonnaturally occurring copies of a naturally occurring nucleotide sequence (i.e., additional copies of a gene that naturally occurs in plants/plant parts of that species that may be, for example in a nonnatural location in the genome).

As used herein, the terms "nucleic acid," "nucleic acid sequence," "nucleotide sequence" and "polynucleotide" refer to deoxyribonucleotide, ribonucleotide and deoxyribonucleotide-ribonucleotide polymers in either single- or double-stranded form and, unless otherwise limited, encompasses analogues having the essential nature of natural polynucleotides in that they hybridize to single-stranded nucleic acids in a manner similar to naturally occurring polynucleotides. Thus, deoxyribopolynucleotides and ribopolynucleotides that have been chemically, enzymatically or metabolically modified for stability or for other reasons and deoxyribopolynucleotides and ribopolynucleotides comprising unusual bases (e.g., inosine and/or tritylated bases) are "nucleic acids" "nucleic acid sequences" "nucleotide sequences" and "polynucleotides" as those terms are used herein.

As used herein, the term "nucleotide" refers to a monomeric unit from which DNA or RNA polymers are constructed and that consists of a purine or pyrimidine base, a pentose, and a phosphoric acid group. Nucleotides (usually found in their 5'-monophosphate form) are referred to by their single letter designation as follows: "A" for adenylate or deoxyadenylate (for RNA or DNA, respectively), "C" for cytidylate or deoxycytidylate, "G" for guanylate or deoxyguanylate, "U" for uridylate, "T" for deoxythymidylate, "R" for purines (A or G), "Y" for pyrimidines (C or T), "K" for G or T, "H" for A or C or T, "I" for inosine, and "N" for any nucleotide.

As used herein, the term "nucleotide sequence identity" refers to the presence of identical nucleotides at corresponding positions of two polynucleotides. Polynucleotides have "identical" sequences if the sequence of nucleotides in the two polynucleotides is the same when aligned for maximum correspondence (e.g., in a comparison window). Sequence comparison between two or more polynucleotides is generally performed by comparing portions of the two sequences over a comparison window to identify and compare local regions of sequence similarity. The comparison window is generally from about 20 to 200 contiguous nucleotides. The "percentage of sequence identity" for polynucleotides, such as about 50, 55, 60, 65, 70, 75, 80, 85, 90, 95, 98, 99 or 100 percent sequence identity, can be determined by comparing two optimally aligned sequences over a comparison window, wherein the portion of the polynucleotide sequence in the comparison window can include additions or deletions (i.e., gaps) as compared to the reference sequence for optimal alignment of the two sequences. The percentage is calculated by: (a) determining the number of positions at which the identical nucleic acid base occurs in both sequences; (b) dividing the number of matched positions by the total number of positions in the window of comparison; and (c) multiplying the result by 100. Optimal alignment of sequences for comparison can also be conducted by computerized implementations of known algorithms, or by visual inspection. Readily available sequence comparison and multiple sequence alignment algorithms are, respectively, the Basic Local Alignment Search Tool (BLAST) and ClustalW programs, both available on the internet. Other suitable programs include, but are not limited to, GAP, BestFit, Plot Similarity, and FASTA, which are part of the Accelrys GCG Package available from Accelrys, Inc. of San Diego, Calif., United States of America. In some embodiments, a percentage of sequence identity refers to sequence identity over the full length of one of the sequences being compared. In some embodiments, a calculation to determine a percentage of sequence identity does not include in the calculation any nucleotide positions in which either of the compared nucleic acids includes an "N" (i.e., where any nucleotide could be present at that position).

As used herein with respect to nucleic acids, the term "operably linked" refers to a functional linkage between two or more nucleic acids. For example, a promoter sequence may be described as being "operably linked" to a heterologous nucleic acid sequence because the promoter sequences initiates and/or mediates transcription of the heterologous nucleic acid sequence. In some embodiments, the operably linked nucleic acid sequences are contiguous and/or are in the same reading frame.

As used herein, the terms "phenotype," "phenotypic trait" or "trait" refer to one or more traits of an organism. The phenotype can be observable to the naked eye, or by any other means of evaluation known in the art, e.g., microscopy, biochemical analysis, or an electromechanical assay. In some cases, a phenotype is directly controlled by a single gene or genetic locus, i.e., a "single gene trait." In other cases, a phenotype is the result of several genes.

As used herein, the term "plant" may refer to any suitable plant, including, but not limited to, spermatophytes (e.g., angiosperms and gymnosperms) and embryophytes (e.g., bryophytes, ferns and fern allies). In some embodiments, the plant is a monocotyledonous (monocot) plant such as a rice, maize, wheat, barley, sorghum, millet, oat, triticale, rye, buckwheat, fonio, quinoa, sugar cane, bamboo, banana, ginger, onion, lily, daffodil, iris, amaryllis, orchid, canna, bluebell, tulip, garlic, secale, einkorn, spelt, emmer, durum, kamut, grass (e.g., gramma grass), teff, milo, flax, *Tripsacum* sp., or teosinte plant. In some embodiments, the plant is a dicotyledonous (dicot) plant such as a blackberry, raspberry, strawberry, barberry, bearberry, blueberry, coffee berry, cranberry, crowberry, currant, elderberry, gooseberry, goji berry, honeyberry, lemon, lime, lingonberry, mangosteen, orange, pepper, persimmon, pomegranate, prune, cotton, clover, acai, plum, peach, nectarin, cherry, guava, almond, pecan, walnut, amaranth, apple, sweet pea, pear, potato, soybean, sugar beet, sunflower, sweet potato, tamarind, tea, tobacco or tomato plant.

As used herein, the term "plant cell" refers to a cell existing in, taken from and/or derived from a plant (e.g., derived from a plant cell/tissue culture). Thus, the term "plant cell" may refer to an isolated plant cell, a plant cell in a culture, a plant cell in an isolated tissue/organ and/or a plant cell in a whole plant.

As used herein, the term "plant part" refers to at least a fragment of a whole plant or to a cell culture or tissue culture derived from a plant. Thus, the term "plant part" may refer to plant cells, plant tissues and plant organs, as well as cell/tissue cultures derived from plant cells, plant tissues and plant cultures. Embodiments of the present invention may comprise and/or make use of any suitable plant part, including, but not limited to, anthers, branches, buds, calli, clumps, cobs, cotyledons, ears, embryos, filaments, flowers, fruits, husks, kernels, leaves, lodicules, ovaries, palea, panicles, pedicels, pods, pollen, protoplasts, roots, root tips, seeds, silks, stalks, stems, stigma, styles, and tassels. In some embodiments, the plant part is a plant germplasm.

As used herein, the term "polymorphism" refers to a variation in the nucleotide sequence at a locus, where said variation is too common to be due merely to a spontaneous mutation. A polymorphism generally has a frequency of at least about 1% in a population. A polymorphism can be a single nucleotide polymorphism (SNP), or an insertion/deletion polymorphism, also referred to herein as an "indel." Additionally, the variation can be in a transcriptional profile or a methylation pattern. The polymorphic site or sites of a nucleotide sequence can be determined by comparing the nucleotide sequences at one or more loci in two or more germplasm entries.

As used herein, the terms "polypeptide," "peptide" and "protein" refer to a polymer of amino acid residues. The terms encompass amino acid polymers in which one or more amino acid residue is an artificial chemical analogue of a corresponding naturally occurring amino acid, as well as to naturally occurring amino acid polymers.

As used herein, the term "population" refers to a genetically heterogeneous collection of plants sharing a common genetic derivation.

As used herein, the term "progeny" refers to plants generated from the vegetative or sexual reproduction of one or more parent plants. Progeny plants may be obtained by cloning or selfing a single parent plant, or by crossing two parental plants. In some embodiments, the progeny plants comprise the markers, alleles, haplotypes and/or genomic regions of the invention. Depending upon the context, it is not always advantageous that the progeny comprise the marker/allele/haplotype/genomic region(s) of the invention associated with increased male fertility (e.g., in hybrid production). Thus, in some embodiments, the progeny of the invention may not comprise the marker/allele/haplotype/genomic region(s) of the invention associated with increased male fertility.

As used herein, the terms "promoter" and "promoter sequence" refer to nucleic acid sequences involved in the regulation of transcription initiation. A "plant promoter" is a promoter capable of initiating transcription in plant cells. Exemplary plant promoters include, but are not limited to, those that are obtained from plants, plant viruses and bacteria that comprise genes expressed in plant cells such *Agrobacterium* or *Rhizobium*. A "tissue-specific promoter" is a promoter that preferentially initiates transcription in a certain tissues. A "stress-inducible promoter" is a promoter that preferentially initiates transcription under certain environmental conditions. A "developmental stage-specific promoter" is a promoter that preferentially initiates transcription during certain developmental stages.

As used herein, the term "quantitative trait locus" (QTL) refers to a genetic locus that comprises and/or is associated with one or more genes underlying a quantitative trait.

As used herein, the term "recessive allele" refers to an allele whose phenotypic effect is not expressed in a heterozygote.

As used herein, the term "recombinant" refers to a molecule (e.g., DNA, RNA, protein, etc.) that results from human manipulation, however indirect, of a nucleic acid molecule.

As used herein, the term "reference sequence" refers to a defined nucleotide sequence used as a basis for nucleotide sequence comparison. The reference sequence for a marker, for example, is obtained by genotyping a number of lines at the locus or loci of interest, aligning the nucleotide sequences in a sequence alignment program, and then obtaining the consensus sequence of the alignment. Hence, a reference sequence identifies the polymorphisms in alleles at a locus. A reference sequence may not be a copy of an actual nucleic acid sequence from any particular organism; however, it is useful for designing primers and probes (as described in Table 9) for actual polymorphisms in the locus or loci.

As used herein, the term "regulatory element" refers to a nucleotide sequence involved in controlling the expression of a nucleic acid sequence of interest. Regulatory elements comprise a promoter operably linked to the nucleic acid sequence of interest and termination signals. They also typically encompass sequences required for proper translation of the nucleotide sequence.

As used herein, the terms "selectively hybridize" and "specifically hybridize" refer to the hybridization of a nucleic acid sequence to a specified nucleic acid target sequence, wherein the nucleic acid sequence preferentially hybridizes to the specified nucleic acid target sequence (e.g., at least about a two-fold difference as compared to its hybridization with non-target nucleic acid sequences) to the substantial exclusion of non-target nucleic acids.

As used herein, the term "stringent hybridization conditions" refers to conditions under which a nucleic acid will selectively hybridize to a target nucleic acid sequence. An extensive guide to the hybridization of nucleic acids is found in Tijssen, *Laboratory Techniques in Biochemistry and Molecular Biology-Hybridization with Nucleic Acid Probes* part I chapter 2 "Overview of principles of hybridization and the strategy of nucleic acid probe assays" Elsevier, New York (1993). In some embodiments, stringent hybridization conditions comprise 7% sodium dodecyl sulfate (SDS), 0.5 M $NaPO_4$, 1 mM EDTA at 50° C. with washing in 0.1×SSC, 0.1% SDS at 65° C. In some embodiments, stringent hybridization conditions comprise a wash stringency of 50% formamide with 5×Denhardt's solution, 0.5% SDS and 1×SSPE at 42° C. Typically, under "stringent conditions" a probe will hybridize to its target subsequence, but to no other sequences.

As used herein, "$T_m$" refers to the temperature (under defined ionic strength and pH) at which 50% of the target sequence hybridizes to a perfectly matched probe. Very stringent conditions are selected to be equal to the $T_m$ for a particular probe. An example of stringent hybridization conditions for hybridization of complementary nucleic acids which have more than 100 complementary residues on a filter in a Southern or northern blot is 50% formamide with 1 mg of heparin at 42° C., with the hybridization being carried out overnight. An example of highly stringent wash conditions is 0.15M NaCl at 72° C. for about 15 minutes. An example of stringent wash conditions is a 0.2×SSC wash at 65° C. for 15 minutes (see, Sambrook, infra, for a description of SSC buffer). Often, a high stringency wash is preceded by a low stringency wash to remove background probe signal. An example medium stringency wash for a duplex of, e.g., more than 100 nucleotides, is 1×SSC at 45° C. for 15 minutes. An example low stringency wash for a duplex of, e.g., more than 100 nucleotides, is 4-6×SSC at 40° C. for 15 minutes. For short probes (e.g., about 10 to 50 nucleotides), stringent conditions typically involve salt concentrations of less than about 1.0 M Na ion, typically about 0.01 to 1.0 M Na ion concentration (or other salts) at pH 7.0 to 8.3, and the temperature is typically at least about 30° C. Stringent conditions can also be achieved with the addition of destabilizing agents such as formamide. In general, a signal to noise ratio of 2× (or higher) than that observed for an unrelated probe in the particular hybridization assay indicates detection of a specific hybridization. Nucleic acids that do not hybridize to each other under stringent conditions are still substantially identical if the proteins that they encode are substantially identical. This occurs, e.g., when a copy of a nucleic acid is created using the maximum codon degeneracy permitted by the genetic code.

The following are examples of sets of hybridization/wash conditions that may be used to clone homologous nucleotide sequences that are substantially identical to reference nucleotide sequences of the present invention: 7% sodium dodecyl sulfate (SDS), 0.5 M NaPO$_4$, 1 mM EDTA at 50° C. with washing in 2×SSC, 0.1% SDS at 50° C.; 7% sodium dodecyl sulfate (SDS), 0.5 M NaPO$_4$, 1 mM EDTA at 50° C. with washing in 1×SSC, 0.1% SDS at 50° C.; 7% sodium dodecyl sulfate (SDS), 0.5 M NaPO$_4$, 1 mM EDTA at 50° C. with washing in 0.5×SSC, 0.1% SDS at 50° C.; 7% sodium dodecyl sulfate (SDS), 0.5 M NaPO$_4$, 1 mM EDTA at 50° C. with washing in 0.1×SSC, 0.1% SDS at 50° C.; 7% sodium dodecyl sulfate (SDS), 0.5 M NaPO$_4$, 1 mM EDTA at 50° C. with washing in 0.1×SSC, 0.1% SDS at 65° C.

A further indication that two nucleic acid sequences or proteins are substantially identical is that the protein encoded by the first nucleic acid is immunologically cross reactive with, or specifically binds to, the protein encoded by the second nucleic acid. Thus, a protein is typically substantially identical to a second protein, for example, where the two proteins differ only by conservative substitutions.

As used herein, the term "substantially fertile" refers to a plant whose fertility is substantially the same as that of a control plant (e.g., one or both of its parents, a near isogenic plant that lacks one or more markers/alleles associated with increased fertility, a near isogenic plant that lacks a vip3 coding sequence, etc.). In some embodiments, substantially fertile plants are plants that release pollen grains at a per tassel per day rate that is at least about 55%, 60%, 65%, 70%, 75%, 80%, 85%, 90% or 95% of that of the control in the three-day period immediately following anther extrusion. In some embodiments, "substantially fertile" plants are plants that release at least about 500,000; 600,000; 700,000; 800,000; 900,000; or 1,000,000 pollen grains per tassel per day in the three-day period immediately following anther extrusion.

As used herein, the phrase "TAQMAN® Assay" refers to real-time sequence detection using PCR based on the TAQMAN® Assay sold by Applied Biosystems, Inc. of Foster City, Calif., United States of America. For an identified marker, a TAQMAN® Assay can be developed for application in a breeding program.

As used herein, the terms "transformation", "transfection" and "transduction" refer to the introduction of an exogenous/heterologous nucleic acid (RNA and/or DNA) into a host cell. A cell has been "transformed," "transfected" or "transduced" with an exogenous/heterologous nucleic acid when such nucleic acid has been introduced or delivered into the cell.

As used herein, the terms "transgenic" and "recombinant" refer to an organism (e.g., a bacterium or plant) that comprises one or more exogenous nucleic acids. Generally, the exogenous nucleic acid is stably integrated within the genome such that at least a portion of the exogenous nucleic acid is passed on to successive generations. The exogenous nucleic acid may be integrated into the genome alone or as part of a recombinant expression cassette. "Transgenic" may be used to designate any plant or plant part the genotype of which has been altered by the presence of an exogenous nucleic acid, including those transgenics initially so altered and those created by sexual crosses or asexual propagation from the initial transgenic. As used herein, the term "transgenic" does not encompass the alteration of the genome (chromosomal or extra-chromosomal) by conventional plant breeding methods or by naturally occurring events such as random cross-fertilization, non-recombinant viral infection, non-recombinant bacterial transformation, non-recombinant transposition or spontaneous mutation.

Transformation of a cell may be stable or transient. Thus, in some embodiments, a plant cell of the invention is stably transformed with a nucleotide sequence encoding a synthetic miRNA precursor molecule of the invention. In other embodiments, a plant of the invention is transiently transformed with a nucleotide sequence encoding a synthetic miRNA precursor molecule of the invention.

"Transient transformation" in the context of a polynucleotide means that a polynucleotide is introduced into the cell and does not integrate into the genome of the cell.

"Stable transformation" or "stably transformed," "stably introducing," or "stably introduced" as used herein means that a nucleic acid is introduced into a cell and integrates into the genome of the cell. As such, the integrated nucleic acid is capable of being inherited by the progeny thereof, more particularly, by the progeny of multiple successive generations. "Genome" as used herein also includes the nuclear and the plastid genome, and therefore includes integration of the nucleic acid into, for example, the chloroplast genome. Stable transformation as used herein can also refer to a transgene that is maintained extrachromasomally, for example, as a minichromosome.

As used herein, the term "transgene" refers to an exogenous nucleic acid. Transgenes may be single- or double-stranded.

As used herein with respect to plants and plant parts, the term "transgenic" refers to a plant or plant part that comprises one or more exogenous nucleic acids.

As used herein, the term "unfavorable allele" refers to a marker allele that segregates with an unfavorable plant phenotype, therefore providing the benefit of identifying plants that can be removed from a breeding program or planting.

As used herein, the term "vector" refers to a nucleic acid molecule for the cloning of and/or transfer of a nucleic acid into a cell. A vector may be a replicon to which another nucleotide sequence may be attached to allow for replication of the attached nucleotide sequence. A "replicon" can be any genetic element (e.g., plasmid, phage, cosmid, chromosome, viral genome) that functions as an autonomous unit of nucleic acid replication in vivo (i.e., is capable of replication under its own control). The term "vector" includes both viral and nonviral (e.g., plasmid) nucleic acid molecules for introducing a nucleic acid into a cell in vitro, ex vivo, and/or in vivo. A large number of vectors known in the art may be used to manipulate nucleic acids, incorporate response elements and promoters into genes, etc. For example, the insertion of nucleic acid fragments corresponding to response elements and promoters into a suitable vector can be accomplished by ligating the appropriate nucleic acid fragments into a chosen vector that has complementary cohesive termini. Alternatively, the ends of the nucleic acid molecules may be enzymatically modified or any site may be produced by ligating nucleotide sequences (linkers) to the nucleic acid termini. Such vectors may be engineered to contain sequences encoding selectable markers that provide for the selection of cells that contain the vector and/or have incorporated the nucleic acid of the vector into the cellular genome. Such markers allow for the identification and/or selection of cells that incorporate and express the proteins encoded by the marker. A "recombinant" vector refers to a viral or non-viral vector that comprises one or more heterologous nucleotide sequences (i.e., transgenes). Vectors may be introduced into cells by any suitable method known in the art, including, but not limited to, transfection, electroporation, microinjection, transduction, cell fusion, DEAE dextran, calcium phosphate precipitation, lipofection (lysosome fusion), and use of a gene gun or nucleic acid vector transporter.

As used herein, the term "Vip3 protein" refers to a vegetative insecticidal protein (VIP) that is a member of the Vip3 class of proteins and includes, but is not limited to, Vip3A(a), Vip3A(b), Vip3A(c), Vip3B, Vip3C(a), Vip3C(b) and Vip3Z proteins and their homologues. Homologues of the aforementioned members of the Vip3 class of proteins include, but are not limited to, proteins that are cross-reactive with antibodies that immunologically recognize one or more of the aforementioned member of the Vip3 class of proteins, proteins that are cross-reactive with receptors (e.g., on a nematode pest or insect gut) affected by one or more of the aforementioned member of the Vip3 class of proteins, proteins having an amino acid sequence that is at least about 70, 71, 72, 73, 74, 75, 76, 77, 78, 79, 80, 81, 82, 83, 84, 85, 86, 87, 88, 89, 90, 91, 92, 93, 94, 95, 96, 97, 98, 99% or more similar or identical to one or more of the aforementioned member of the Vip3 class of proteins, and proteins having a toxic core region, the amino acid sequence of which is at least about 70, 71, 72, 73, 74, 75, 76, 77, 78, 79, 80, 81, 82, 83, 84, 85, 86, 87, 88, 89, 90, 91, 92, 93, 94, 95, 96, 97, 98, 99% or more similar or identical to the toxic core region of one or more of the aforementioned member of the Vip3 class of proteins. Homologues of the aforementioned members of the Vip3 class of proteins may exhibit pesticidal activity (e.g., nematicidal and/or insecticidal) when expressed in a transgenic maize plant or plant part. Examples of Vip3 proteins (and corresponding GenBank accession numbers and/or U.S. patent publication numbers) are described in Table 4.

Markers can be used in a variety of plant breeding applications. See, e.g., Staub et al., *Hortscience* 31: 729 (1996); Tanksley, *Plant Molecular Biology Reporter* 1: 3 (1983). One of the main areas of interest is to increase the efficiency of backcrossing and introgressing genes using marker-assisted selection (MAS). In general, MAS takes advantage of genetic markers that have been identified as having a significant likelihood of co-segregation with a desired trait. Such markers are presumed to be in/near the gene(s) that give rise to the desired phenotype, and their presence indicates that the plant will possess the desired trait. Plants which possess the marker are expected to transfer the desired phenotype to their progeny.

A marker that demonstrates linkage with a locus affecting a desired phenotypic trait provides a useful tool for the selection of the trait in a plant population. This is particularly true where the phenotype is hard to assay or occurs at a late stage in plant development. Since DNA marker assays are less laborious and take up less physical space than field phenotyping, much larger populations can be assayed, increasing the chances of finding a recombinant with the target segment from the donor line moved to the recipient line. The closer the linkage, the more useful the marker, as recombination is less likely to occur between the marker and the gene causing or imparting the trait. Having flanking markers decreases the chances that false positive selection will occur. The ideal situation is to have a marker in the gene itself, so that recombination cannot occur between the marker and the gene. Such a marker is called a "perfect marker."

When a gene is introgressed by MAS, it is not only the gene that is introduced but also the flanking regions. Gepts, *Crop Sci.* 42:1780 (2002). This is referred to as "linkage drag." In the case where the donor plant is highly unrelated to the recipient plant, these flanking regions carry additional genes that may code for agronomically undesirable traits. This "linkage drag" may also result in reduced yield or other negative agronomic characteristics even after multiple cycles of backcrossing into the elite maize line. This is also sometimes referred to as "yield drag." The size of the flanking region can be decreased by additional backcrossing, although this is not always successful, as breeders do not have control over the size of the region or the recombination breakpoints. Young et al., *Genetics* 120:579 (1998). In classical breeding, it is usually only by chance that recombinations which contribute to a reduction in the size of the donor segment are selected. Tanksley et al., *Biotechnology* 7: 257 (1989). Even after 20 backcrosses, one may expect to find a sizeable piece of the donor chromosome still linked to the gene being selected. With markers, however, it is possible to select those rare individuals that have experienced recombination near the gene of interest. In 150 backcross plants, there is a 95% chance that at least one plant will have experienced a crossover within 1 cM of the gene, based on a single meiosis map distance. Markers allow for unequivocal identification of those individuals. With one additional backcross of 300 plants, there would be a 95% chance of a crossover within 1 cM single meiosis map distance of the other side of the gene, generating a segment around the target gene of less than 2 cM based on a single meiosis map distance. This can be accomplished in two generations with markers, while it would have required on average 100 generations without markers. See Tanksley et al., supra. When the exact location of a gene is known, flanking markers surrounding the gene can be utilized to select for recombinations in different population sizes. For example, in smaller population sizes, recombinations may be expected further away from the gene, so more distal flanking markers would be required to detect the recombination.

The availability of integrated linkage maps of the maize genome containing increasing densities of public maize markers has facilitated maize genetic mapping and MAS. See, e.g. the IBM2 Neighbors maps, which are available online on the MaizeGDB website.

Of all the molecular marker types, SNPs are the most abundant and have the potential to provide the highest genetic map resolution. Bhattramakki et al., *Plant Molec. Biol.* 48:539 (2002). SNPs can be assayed in a so-called "ultra-high-throughput" fashion because they do not require large amounts of nucleic acid and automation of the assay is straight-forward. SNPs also have the benefit of being relatively low-cost systems. These three factors together make SNPs highly attractive for use in MAS. Several methods are available for SNP genotyping, including but not limited to, hybridization, primer extension, oligonucleotide ligation, nuclease cleavage, minisequencing and coded spheres. Such methods have been reviewed in various publications: Gut, *Hum. Mutat.* 17:475 (2001); Shi, *Clin. Chem.* 47:164 (2001); Kwok, *Pharmacogenomics* 1:95 (2000); Bhattramaldd and Rafalski, *Discovery and application of single nucleotide polymorphism markers in plants, in* PLANT GENOTYPING: THE DNA FINGERPRINTING OF PLANTS, CABI Publishing, Wallingford (2001). A wide range of commercially available technologies utilize these and other methods to interrogate SNPs, including Masscode™ (Qiagen, Germantown, Md.), Invader® (Hologic, Madison, Wis.), SnapShot® (Applied Biosystems, Foster City, Calif.), Taqman® (Applied Biosystems, Foster City, Calif.) and Beadarrays™ (Illumina, San Diego, Calif.).

A number of SNPs together within a sequence, or across linked sequences, can be used to describe a haplotype for any particular genotype. Ching et al., *BMC Genet.* 3:19 (2002); Gupta et al., (2001), *Rafalski, Plant Sci.* 162:329 (2002b). Haplotypes can be more informative than single SNPs and can be more descriptive of any particular genotype. For example, a single SNP may be allele "T" for a specific donor line or variety, but the allele "T" might also occur in the maize breeding population being utilized for recurrent parents lacking the favorable allele. In this case, a combination of alleles at linked SNPs may be more informative. Once a unique haplotype has been assigned to a donor chromosomal region, that haplotype can be used in that population or any subset thereof to determine whether an individual has a particular gene. The use of automated high throughput marker detection platforms known to those of ordinary skill in the art makes this process highly efficient and effective.

The present invention provides markers associated with increased fertility (e.g., increased male fertility). Analysis of these markers can be used to identify, select and/or produce fertile maize plants, to identify infertile maize plants, to predict whether and/or to what extent a maize plant will be fertile, to increase the efficiency of and/or reduce the cost of breeding and/or seed production programs, etc.

Markers of the present invention may comprise, consist essentially of or consist of a single allele or a combination of alleles at one or more genetic loci. For example, the marker may comprise a marker allele located at a first marker locus, a marker allele at a second marker locus, a marker allele at a third marker locus, a fourth marker at a fourth marker locus, etc.

In some embodiments, the marker is located within one or more of the chromosomal segments described in Table 1 as if each interval and all possible combinations thereof were individually set forth. For example, the marker may be located within one or more of chromosomal segments 46 to 12473 (e.g., within chromosomal segment 7514).

In some embodiments, the marker comprises, consists essentially of or consists of an allele of interest located within one or more of the chromosomal segments described in Table 1. For example, in some embodiments, the marker comprises, consists essentially of or consists of an allele of interest located within one or more of chromosomal segments 46 to 12473 (e.g., an allele of interest located within chromosomal segment 7514).

In some embodiments, the marker comprises, consists essentially of or consists of a haplotype comprising, consisting essentially of, or consisting of two or more alleles of interest located within one or more of the chromosomal segments described in Table 1. For example, in some embodiments, the marker comprises, consists essentially of or consists of a haplotype comprising, consisting essentially of, or consisting of two or more alleles of interest located within one or more of chromosomal segments 46 to 12473 (e.g., a haplotype comprising two or more alleles of interest located within chromosomal segment 7514).

In some embodiments, the marker comprises, consists essentially of or consists of a haplotype comprising, consisting essentially of, or consisting of one or more alleles of interest located within a first chromosomal segment, one or more alleles of interest located within a second chromosomal segment different from the first chromosomal segment, one or more alleles of interest located within a third chromosomal segment different from the first and second chromosomal segments, etc., wherein each of the chromosomal segments comprises one or more of the chromosomal segments described in Table 1. For example, in some embodiments, the marker comprises, consists essentially of or consists of a haplotype comprising, consisting essentially of, or consisting of:

1) one or more alleles of interest located within one or more of chromosomal segments 46 to 12473 (e.g., one or more alleles of interest located within chromosomal segment 7514) and one or more alleles of interest located within chromosomal segment 1;
2) one or more alleles of interest located within one or more of chromosomal segments 46 to 12473 (e.g., one or more alleles of interest located within chromosomal segment 7514) and one or more alleles of interest located on chromosome 2;
3) one or more alleles of interest located within one or more of chromosomal segments 46 to 12473 (e.g., one or more alleles of interest located within chromosomal segment 7514) and one or more alleles of interest located within one or more of chromosomal segments 3 to 17 (e.g., one or more alleles of interest located within chromosomal segment 3);
4) one or more alleles of interest located within one or more of chromosomal segments 46 to 12473 (e.g., one or more alleles of interest located within chromosomal segment 7514) and one or more alleles of interest located within one or more of chromosomal segments 18 to 45 (e.g., one or more alleles of interest located within chromosomal segment 25);
5) one or more alleles of interest located within one or more of chromosomal segments 46 to 12473 (e.g., one or more alleles of interest located within chromosomal segment 7514) and one or more alleles of interest located within one or more of chromosomal segments 12744 to 12749 (e.g., one or more alleles of interest located within chromosomal segment 12747);
6) one or more alleles of interest located within one or more of chromosomal segments 46 to 12473 (e.g., one or more alleles of interest located within chromosomal segment 7514) and one or more alleles of interest located within one or more of chromosomal segments 12750 to 12755 (e.g., one or more alleles of interest located within chromosomal segment 12753);
7) one or more alleles of interest located within one or more of chromosomal segments 46 to 12473 (e.g., one or more alleles of interest located within chromosomal segment 7514) and one or more alleles of interest located within chromosomal segment 12756;
8) one or more alleles of interest located within one or more of chromosomal segments 46 to 12473 (e.g., one or more alleles of interest located within chromosomal segment 7514) and one or more alleles of interest located within one or more of chromosomal segments 12757 to 12762 (e.g., one or more alleles of interest located within chromosomal segment 12760 and/or chromosomal segment 12761);
9) one or more alleles of interest located within one or more of chromosomal segments 46 to 12473 (e.g., one or more alleles of interest located within chromosomal segment 7514) and one or more alleles of interest located within one or more of chromosomal segments 12763 to 12768 (e.g., one or more alleles of interest located within chromosomal segment 12768);
10) one or more alleles of interest located within one or more of chromosomal segments 46 to 12473 (e.g., one or more alleles of interest located within chromosomal segment 7514), one or more alleles of interest located within one or more of chromosomal segments 3 to 17 (e.g., one or more alleles of interest located within chromosomal segment 3), one or more alleles of interest located within one or more of chromosomal segments 18 to 45 (e.g., one or more alleles of interest located within chromosomal segment 25) and one or more alleles of interest located within one or more of chromosomal segments 12763 to 12768 (e.g., one or more alleles of interest located within chromosomal segment 12768);

11) one or more alleles of interest located within one or more of chromosomal segments 3 to 17 (e.g., one or more alleles of interest located within chromosomal segment 3) and one or more alleles of interest located within chromosomal segment 1;

12) one or more alleles of interest located within one or more of chromosomal segments 3 to 17 (e.g., one or more alleles of interest located within chromosomal segment 3) and one or more alleles of interest located on chromosome 2;

13) one or more alleles of interest located within one or more of chromosomal segments 3 to 17 (e.g., one or more alleles of interest located within chromosomal segment 3) and one or more alleles of interest located within one or more of chromosomal segments 18 to 45 (e.g., one or more alleles of interest located within chromosomal segment 25);

14) one or more alleles of interest located within one or more of chromosomal segments 3 to 17 (e.g., one or more alleles of interest located within chromosomal segment 3) and one or more alleles of interest located within one or more of chromosomal segments 12744 to 12749 (e.g., one or more alleles of interest located within chromosomal segment 12747);

15) one or more alleles of interest located within one or more of chromosomal segments 3 to 17 (e.g., one or more alleles of interest located within chromosomal segment 3) and one or more alleles of interest located within one or more of chromosomal segments 12750 to 12755 (e.g., one or more alleles of interest located within chromosomal segment 12753);

16) one or more alleles of interest located within one or more of chromosomal segments 3 to 17 (e.g., one or more alleles of interest located within chromosomal segment 3) and one or more alleles of interest located within chromosomal segment 12756;

17) one or more alleles of interest located within one or more of chromosomal segments 3 to 17 (e.g., one or more alleles of interest located within chromosomal segment 3) and one or more alleles of interest located within one or more of chromosomal segments 12757 to 12762 (e.g., one or more alleles of interest located within chromosomal segment 12760 and/or chromosomal segment 12761);

18) one or more alleles of interest located within one or more of chromosomal segments 3 to 17 (e.g., one or more alleles of interest located within chromosomal segment 3) and one or more alleles of interest located within one or more of chromosomal segments 12763 to 12768 (e.g., one or more alleles of interest located within chromosomal segment 12768);

19) one or more alleles of interest located within one or more of chromosomal segments 3 to 17 (e.g., one or more alleles of interest located within chromosomal segment 3), one or more alleles of interest located within one or more of chromosomal segments 12750 to 12755 (e.g., one or more alleles of interest located within chromosomal segment 12753) and one or more alleles of interest located within chromosomal segment 12756.

In embodiments, the marker comprises one or more of the desired alleles described in Table 8. For example, in some embodiments, the marker comprises at least about 2, 3, 4, 5, 6, 7, 8, 9, 10, 11, 12, 13, 14, 15, 16, 17 or more, or all 18 of the desired alleles described in Table 8.

In embodiments, the marker comprises one or more of the favorable (desired) alleles:

(a) on chromosome 5 (QTL 5.1 and/or QTL 5.2) as described in Table 8;
(b) on chromosome 3 as described in Table 8;
(c) on chromosome 7 as described in Table 8;
(d) on chromosome 10 as described in Table 8;
(e) on chromosomes 3 and 5 as described in Table 8;
(f) on chromosomes 5 and 7 as described in Table 8;
(g) on chromosomes 3, 5 and 7 as described in Table 8;
(h) on chromosomes 5 and 10 as described in Table 8;
(i) on chromosomes 3, 5 and 10 as described in Table 8; or
(j) any combination of (a) to (i).

In embodiments, the marker comprises one or more of the favorable (desired) alleles described in Table 10.

In some embodiments, the marker comprises, consists essentially of or consists of one or more marker alleles linked to one or more of the markers, chromosomal segments, alleles and/or haplotypes described herein. In some embodiments, the marker allele and the marker(s), segment(s), allele(s) and/or haplotype(s) described herein are separated by less than about 50, 40, 30, 25, 20, 15, 10, 5, 4, 3, 2, or 1 cM. In some embodiments, the pairwise $r^2$ value(s) of the marker allele and the marker(s)/segment(s)/allele(s)/haplotype(s) described herein is/are greater than or equal to about 0.33, 0.4, 0.5, 0.6, 0.7, 0.8, 0.9, or 1.0. In some embodiments, the LOD score for the marker allele and the marker(s)/segment(s)/allele(s)/haplotype(s) described herein is greater than or equal to about 0.5, 1, 1.5, 2, 2.5, 3, 3.5, 4, 4.5, 5, 5.5, 6, 6.5, 7, 7.5, 8, 8.5, 9, 9.5, 10, 11, 12, 13, 14, 15, 16, 17, 18, 19, 20 or more. Linked markers may be determined, for example, by using resources available on the MaizeGDB website (www.maizegdb.org).

In some embodiments, the marker comprises, consists essentially of or consists of a marker allele located within about 25 cM, 20 cM, 15 cM, 10 cM, 5 cM or 1 cM or less (the term "within" including the end point of the specified region) of any one of the markers, chromosomal segments, alleles and/or haplotypes described herein. For example, in some embodiments, the marker allele comprises, consists essentially of or consists of one or more markers located within about 25 cM, 10 cM, 5 cM, 1 cM or less of chromosomal segment 7514.

In some embodiments, the marker is not in the natural genetic background of the maize plant (e.g., is not naturally occurring in the maize line or variety, and has been introduced therein by human intervention).

Markers of the present invention may associated with any suitable trait, including, but not limited to, increased pollen production per plant, increased pollen production per tassel, increased pollen production per anther, improved pollen morphology, increased anther production per plant, increased anther production per tassel, improved anther morphology, increased tassel production per plant, improved tassel morphology, increased fertility (e.g., increased male fertility) under stress conditions (e.g., drought conditions), increased fertility (e.g., increased male fertility) under elevated daytime temperatures, increased fertility (e.g., increased male fertility) under elevated nighttime temperatures and/or increased fertility (e.g., increased male fertility) under conditions comprising a large differential between daytime temperatures and nighttime temperatures.

Markers of the present invention may be analyzed using any suitable marker probe, including, but not limited to, the marker probes described herein.

Markers of the present invention may be detected in any suitable amplification product, including, but not limited to, the amplification products described herein.

Markers of the present invention may be analyzed using any suitable technique(s), including, but not limited to, PCR-based detection methods (e.g., TAQMAN® Assays), polymorphism detection techniques (see, e.g., U.S. Pat. Nos. 5,468,613; 5,217,863; 5,210,015; 5,876,930; 6,030,787; 6,004,744; 6,013,431; 5,595,890; 5,762,876; 5,945,283; 5,468,613; 6,090,558; 5,800,944; 5,616,464; 7,312,039; 7,238,476; 7,297,485; 7,282,355; 7,270,981 and 7,250,252), probe ligation techniques (see, e.g., U.S. Pat. No. 5,800,944), microarray techniques (see, e.g., U.S. Pat. Nos. 6,799,122; 6,913,879 and 6,996,476; see also Borevitz et al., GENOME RES. 13:513-523 (2003); Cui et al., BIOINFORMATICS 21:3852-3858 (2005)), probe linking methods (e.g., U.S. Pat. No. 5,616,464), single base extension methods (see, e.g., U.S. Pat. Nos. 6,004,744; 6,013,431; 5,595,890; 5,762,876 and 5,945,283), fluorescent tagging methods (e.g., U.S. Pat. Nos. 5,210,015; 5,876,930 and 6,030,787) and direct sequencing (see, e.g., Service, SCIENCE 2006 311:1544-1546 (2006)).

The present invention also provides nonnaturally occurring plants and plant parts comprising one or more markers associated with increased fertility (e.g., increased male fertility).

The present invention extends to products harvested from nonnaturally occurring plants of the present invention, including, but not limited to, plant cells and harvestable plant parts including but not limited to seeds, leaves, fruits, flowers, stems, rhizomes, tubers and bulbs.

In some embodiments, the harvested product can be a plant cell or plant part capable of producing a plant having increased fertility (e.g., increased male fertility).

The present invention also extends to products derived from nonnaturally occurring plants and plant parts of the present invention, including, but not limited to, dry pellets and powders, oils, fats, fatty acids, starches and proteins.

Markers and nonnaturally occurring plants and plant parts of the present invention may comprise any suitable allele(s), haplotype(s) and/or molecule(s) of interest.

In some embodiments, the allele of interest comprises, consists essentially of or consists of one or more nucleic acid sequences derived from NP2222 maize germplasm. For example, the alleles of interest may comprise, consist essentially of or consist of one or more of the chromosomal segments described in Table 1, wherein the chromosomal segment is at least about 75%, 80%, 85%, 90%, 95%, 96%, 97%, 98%, 99%, 99.5% or more identical to the corresponding segment(s) of NP2222 maize germplasm. In some such embodiments, the allele of interest comprises, consists essentially of or consists of one or more of chromosomal segments 3 to 12768, (e.g., chromosomal segments 3, 13, 25, 506, 7514, 7546, 12747, 12753, 12760-12761 and/or 12767-12768) of NP2222 maize germplasm.

In some embodiments, the allele of interest comprises, consists essentially of or consists of one or more nucleic acid sequences derived from NP2660 maize germplasm. For example, the alleles of interest may comprise, consist essentially of or consist of one or more of the chromosomal segments described in Table 1, wherein the chromosomal segment is at least about 75%, 80%, 85%, 90%, 95%, 96%, 97%, 98%, 99%, 99.5% or more identical to the corresponding segment(s) of NP2660 maize germplasm. In some such embodiments, the allele of interest comprises, consists essentially of or consists of one or more of chromosomal segments 3 to 12743 and/or one or more of chromosomal segments 12757 to 12768, (e.g., chromosomal segments 3, 13, 25, 506, 7514, 7546, 12747, 12753, 12760-12761 and/or 12767-12768) of NP2660 maize germplasm.

In some embodiments, the allele of interest comprises, consists essentially of or consists of one or more nucleic acid sequences derived from NP2276 maize germplasm. For example, the alleles of interest may comprise, consist essentially of or consist of one or more of the chromosomal segments described in Table 1, wherein the chromosomal segment is at least about 75%, 80%, 85%, 90%, 95%, 96%, 97%, 98%, 99%, 99.5% or more identical to the corresponding segment(s) of NP2276 maize germplasm. In some such embodiments, the allele of interest comprises, consists essentially of or consists of chromosomal segment 1, one or more of chromosomal segments 46 to 12743 and/or one or more of chromosomal segments 12757 to 12768, (e.g., chromosomal segments 13, 506, 7514, 7546 and/or 12760-12761) of NP2276 maize germplasm.

In some embodiments, the allele of interest comprises, consists essentially of or consists of one or more nucleic acid sequences derived from ID3461 maize germplasm. For example, the alleles of interest may comprise, consist essentially of or consist of one or more of the chromosomal segments described in Table 1, wherein the chromosomal segment is at least about 75%, 80%, 85%, 90%, 95%, 96%, 97%, 98%, 99%, 99.5% or more identical to the corresponding segment(s) of ID3461 maize germplasm. In some such embodiments, the allele of interest comprises, consists essentially of or consists of one or more of chromosomal segments 1 to 17 (e.g., chromosomal segments 1 and/or 13) of ID3461 maize germplasm.

In embodiments, the allele of interest comprises, consists essentially of or consists of one or more nucleic acid sequences derived from a line in Table 11.

In some embodiments, the allele of interest comprises, consists essentially of or consists of at least one of SEQ ID NOs: 1 to 350 (as described in Table 3).

In some embodiments, the allele of interest comprises, consists essentially of or consists of at least one nucleotide sequence that is at least about 75%, 80%, 85%, 90%, 95%, 96%, 97%, 98%, 99%, 99.5% or more identical to one or more of SEQ ID NOs: 1 to 350 (as described in Table 3).

In some embodiments, the allele of interest comprises, consists essentially of or consists of at least one nucleotide sequence that specifically hybridizes to the nucleotide sequence of one or more of SEQ ID NOs: 1 to 350 (as described in Table 3) under stringent hybridization conditions.

In some embodiments, the allele of interest comprises, consists essentially of or consists of at least one nucleotide sequence that encodes the amino acid sequence set forth in one or more of SEQ ID NOs: 351 to 525 (as described in Table 3).

In some embodiments, the allele of interest comprises, consists essentially of or consists of at least one nucleotide sequence that encodes an amino acid sequence that is at least about 75%, 80%, 85%, 90%, 95%, 96%, 97%, 98%, 99%, 99.5% or more identical to the amino acid sequence set forth in one or more of SEQ ID NOs: 351 to 525 (as described in Table 3).

In some embodiments, the allele of interest comprises, consists essentially of or consists of at least one of SEQ ID NOs: 526 to 613 (as described in Table 9).

In some embodiments, the allele of interest comprises, consists essentially of or consists of at least one nucleotide sequence that is at least about 75%, 80%, 85%, 90%, 95%, 96%, 97%, 98%, 99%, 99.5% or more identical to one or more of SEQ ID NOs: 526 to 613 (as described in Table 9).

In some embodiments, the allele of interest comprises, consists essentially of or consists of at least one nucleotide sequence that specifically hybridizes to the nucleotide sequence of one or more of SEQ ID NOs: 526 to 613 (as described in Table 9) under stringent hybridization conditions.

In some embodiments, the allele of interest comprises, consists essentially of or consists of one or more of the desired alleles described in Table 2. For example, in some embodiments, the marker comprises, consists essentially of or consists of at least about 2, 3, 4, 5, 6, 7, 8, 9, 10, 11, 12, 13, 14, 15, 20, 25, 30, 35, 40, 45, 50, 55, 60, 65, 70, 75, 80, 85, 90, 95, 100, 110, 120, 130, 140 or more of the desired alleles described in Table 2.

In embodiments, the allele of interest comprises one or more of the desired alleles described in Table 8. For example, in some embodiments, the marker comprises at least about 2, 3, 4, 5, 6, 7, 8, 9, 10, 11, 12, 13, 14, 15, 16, 17 or more, or all 18 of the desired alleles described in Table 8.

In embodiments, the allele of interest comprises one or more of the desired alleles:

(a) on chromosome 5 (QTL 5.1 and/or QTL 5.2) as described in Table 8;
(b) on chromosome 3 as described in Table 8;
(c) on chromosome 7 as described in Table 8;
(d) on chromosome 10 as described in Table 8;
(e) on chromosomes 3 and 5 as described in Table 8;
(f) on chromosomes 5 and 7 as described in Table 8;
(g) on chromosomes 3, 5 and 7 as described in Table 8;
(h) on chromosomes 5 and 10 as described in Table 8;
(i) on chromosomes 3, 5 and 10 as described in Table 8; or
(j) any combination of (a) to (i).

In embodiments, the allele of interest comprises one or more of the desired alleles described in Table 10. For example, in some embodiments, the marker comprises at least about 2, 3, 4, 5, 6, 7, 8, 9, 10, 11, 12, 13, 14, 15, 20, 25 or more of the desired alleles described in Table 10.

In some embodiments, the allele of interest comprises, consists essentially of or consists of the reverse complement of one of the alleles of interest described herein.

In some embodiments, the allele of interest comprises, consists essentially of or consists of an informative fragment of one of the alleles of interest described herein.

In some embodiments, the allele of comprises, consists essentially of or consists of an informative fragment of the reverse complement of one of the alleles of interest described herein.

In some embodiments, the allele of interest is not in the natural genetic background of the maize plant (e.g., is not naturally occurring in the maize line or variety, and has been introduced therein by human intervention).

In some embodiments, the haplotype of interest comprises, consists essentially of or consists of nucleic acid sequences derived from NP2222 maize germplasm. For example, the haplotype of interest may comprise, consist essentially of or consist of one or more (or two or more) of the chromosomal segments described in Table 1, wherein the chromosomal segment is at least about 75%, 80%, 85%, 90%, 95%, 96%, 97%, 98%, 99%, 99.5% or more identical to the corresponding segment(s) of NP2222 maize germplasm. In some such embodiments, the haplotype of interest comprises one or more nucleic acid sequences is at least about 75%, 80%, 85%, 90%, 95%, 96%, 97%, 98%, 99%, 99.5% or more identical to one or more of chromosomal segments 3 to 12768, (e.g., chromosomal segments 3, 13, 25, 506, 7514, 7546, 12747, 12753, 12760-12761 and/or 12767-12768) of NP2222 maize germplasm.

In some embodiments, the haplotype of interest comprises, consists essentially of or consists of nucleic acid sequences derived from NP2660 maize germplasm. For example, the haplotype of interest may comprise, consist essentially of or consist of one or more (or two or more) of the chromosomal segments described in Table 1, wherein the chromosomal segment is at least about 75%, 80%, 85%, 90%, 95%, 96%, 97%, 98%, 99%, 99.5% or more identical to the corresponding segment(s) of NP2660 maize germplasm. In some such embodiments, the haplotype of interest comprises one or more nucleic acid sequences is at least about 75%, 80%, 85%, 90%, 95%, 96%, 97%, 98%, 99%, 99.5% or more identical to one or more of chromosomal segments 3 to 12743 and/or one or more of chromosomal segments 12757 to 12768, (e.g., chromosomal segments 3, 13, 25, 506, 7514, 7546, 12747, 12753, 12760-12761 and/or 12767-12768) of NP2660 maize germplasm.

In some embodiments, the haplotype of interest comprises, consists essentially of or consists of nucleic acid sequences derived from NP2276 maize germplasm. For example, the haplotype of interest may comprise, consist essentially of or consist of one or more (or two or more) of the chromosomal segments described in Table 1, wherein the chromosomal segment is at least about 75%, 80%, 85%, 90%, 95%, 96%, 97%, 98%, 99%, 99.5% or more identical to the corresponding segment(s) of NP2276 maize germplasm. In some such embodiments, the haplotype of interest comprises one or more nucleic acid sequences is at least about 75%, 80%, 85%, 90%, 95%, 96%, 97%, 98%, 99%, 99.5% or more identical to chromosomal segment 1, one or more of chromosomal segments 46 to 12743 and/or one or more of chromosomal segments 12757 to 12768, (e.g., chromosomal segments 13, 506, 7514, 7546 and/or 12760-12761) of NP2276 maize germplasm.

In some embodiments, the haplotype of interest comprises, consists essentially of, or consists of nucleic acid sequences derived from ID3461 maize germplasm. For example, the haplotype of interest may comprise, consist essentially of or consist of one or more (or two or more) of the chromosomal segments described in Table 1, wherein the chromosomal segment is at least about 75%, 80%, 85%, 90%, 95%, 96%, 97%, 98%, 99%, 99.5% or more identical to the corresponding segment(s) of ID3461 maize germplasm. In some such embodiments, the haplotype of interest comprises one or more nucleic acid sequences is at least about 75%, 80%, 85%, 90%, 95%, 96%, 97%, 98%, 99%, 99.5% or more identical to one or more of chromosomal segments 1 to 17 (e.g., chromosomal segments 1 and/or 13) of ID3461 maize germplasm.

In embodiments, the haplotype of interest comprises, consists essentially of or consists of one or more nucleic acid sequences derived from a line in Table 11.

In some embodiments, the haplotype of interest comprises one or more of the nucleic acid sequences set forth in SEQ ID NOs: 1 to 350 (as described in Table 3).

In some embodiments, the haplotype of interest comprises one or more (or two or more) nucleotide sequences that is/are at least about 75%, 80%, 85%, 90%, 95%, 96%, 97%, 98%, 99%, 99.5% or more identical to one or more of SEQ ID NOs: 1 to 350 (as described in Table 3).

In some embodiments, the haplotype of interest comprises one or more (or two or more) nucleotide sequences that specifically hybridize to the nucleotide sequence of one or more of SEQ ID NOs: 1 to 350 (as described in Table 3) under stringent hybridization conditions.

In some embodiments, the haplotype of interest comprises one or more (or two or more) nucleotide sequences encoding the amino acid sequence set forth in one or more of SEQ ID NOs: 351 to 525 (as described in Table 3).

In some embodiments, the haplotype of interest comprises one or more (or two or more) nucleotide sequences encoding an amino acid sequence that is at least about 75%, 80%, 85%, 90%, 95%, 96%, 97%, 98%, 99%, 99.5% or more identical to the amino acid sequence set forth in one or more of SEQ ID NOs: 351 to 525 (as described in Table 3).

In some embodiments, the haplotype of interest comprises one or more (or two or more) of the nucleic acid sequences set forth in SEQ ID NOs: 526 to 613 (as described in Table 9).

In some embodiments, the haplotype of interest comprises one or more (or two or more) nucleotide sequences that is/are at least about 75%, 80%, 85%, 90%, 95%, 96%, 97%, 98%, 99%, 99.5% or more identical to one or more of SEQ ID NOs: 526 to 613 (as described in Table 9).

In some embodiments, the haplotype of interest comprises one or more (or two or more) nucleotide sequences that specifically hybridize to the nucleotide sequence of one or more of SEQ ID NOs: 526 to 613 (as described in Table 9) under stringent hybridization conditions.

In some embodiments, the haplotype of interest comprises one or more of the desired alleles described in Table 2. For example, in some embodiments, the haplotype of interest comprises, consists essentially of or consists of at least about 2, 3, 4, 5, 6, 7, 8, 9, 10, 11, 12, 13, 14, 15, 20, 25, 30, 35, 40, 45, 50, 55, 60, 65, 70, 75, 80, 85, 90, 95, 100, 110, 120, 130, 140 or more of the desired alleles described in Table 2.

In embodiments, the haplotype of interest comprises one or more of the desired alleles described in Table 8. For example, in some embodiments, the haplotype of interest comprises at least about 2, 3, 4, 5, 6, 7, 8, 9, 10, 11, 12, 13, 14, 15, 16, 17 or more, or all 18 of the desired alleles described in Table 8.

In embodiments, the haplotype of interest comprises one or more (or two or more) of the desired allele(s):

(a) on chromosome 5 (QTL 5.1 and/or QTL 5.2) as described in Table 8;
(b) on chromosome 3 as described in Table 8;
(c) on chromosome 7 as described in Table 8;
(d) on chromosome 10 as described in Table 8;
(e) on chromosomes 3 and 5 as described in Table 8;
(f) on chromosomes 5 and 7 as described in Table 8;
(g) on chromosomes 3, 5 and 7 as described in Table 8;
(h) on chromosomes 5 and 10 as described in Table 8;
(i) on chromosomes 3, 5 and 10 as described in Table 8; or
(j) any combination of (a) to (i).

In embodiments, the haplotype of interest comprises one or more (or two or more) of the desired alleles described in Table 10. For example, in some embodiments, the haplotype of interest comprises at least about 2, 3, 4, 5, 6, 7, 8, 9, 10, 11, 12, 13, 14, 15, 20, 25 or more of the desired alleles described in Table 10.

In some embodiments, the haplotype of interest comprises the reverse complement of one or more (or two or more) of the alleles of interest described herein. For example, in some embodiments, at least one allele of interest in a haplotype of interest is present as described herein, whilst at least one other allele of interest in the haplotype of interest is present as the reverse complement of the allele(s) described herein.

In some embodiments, the haplotype of interest comprises an informative fragment of one or more (or two or more) of the alleles of interest described herein. For example, in some embodiments, at least one allele of interest in a haplotype of interest is present as described herein, whilst at least one other allele of interest in the haplotype of interest is present as an informative fragment of the allele(s) described herein.

In some embodiments, the haplotype of interest comprises an informative fragment of the reverse complement of one or more (or two or more) of the alleles of interest described herein. For example, in some embodiments, at least one allele of interest in a haplotype of interest is present as described herein, whilst at least one other allele of interest in the haplotype of interest is present as an informative fragment of the reverse complement of the allele(s) described herein.

In some embodiments, the molecule of interest comprises, consists essentially of or consists of at least one of SEQ ID NOs: 351 to 525 (as described in Table 3).

In some embodiments, the molecule of interest comprises, consists essentially of or consists of at least one amino acid sequence that is at least about 75%, 80%, 85%, 90%, 95%, 96%, 97%, 98%, 99%, 99.5% or more identical to one or more of SEQ ID NOs: 351 to 525 (as described in Table 3).

In some embodiments, the molecule of interest is not in the natural proteome of the maize plant (e.g., is not naturally occurring in the maize line or variety, and has been introduced therein by human intervention).

In some embodiments, the allele/haplotype/molecule of interest is associated with increased pollen production per plant, increased pollen production per tassel, increased pollen production per anther, improved pollen morphology, increased anther production per plant, increased anther production per tassel, improved anther morphology, increased tassel production per plant, improved tassel morphology, increased fertility (e.g., increased male fertility) under stress conditions (e.g., drought conditions), increased fertility (e.g., increased male fertility) under elevated daytime temperatures, increased fertility (e.g., increased male fertility) under elevated nighttime temperatures and/or increased fertility (e.g., increased male fertility) under conditions comprising a large differential between daytime temperatures and nighttime temperatures.

Markers and nonnaturally occurring plants and plant parts of the present invention may comprise any suitable number of alleles, haplotypes and/or molecules of interest as described herein.

In some embodiments, the marker/nonnaturally occurring plant or plant part comprises at least 2, 3, 4, 5, 6, 7, 8, 9, 10, 11, 12, 13, 14, 15, 20, 25, 30, 35, 40, 45, 50, 55, 60, 65, 70, 75, 80, 85, 90, 95, 100, 110, 120, 130, 140 or more alleles, haplotypes and/or molecules of interest associated with increased fertility (e.g., increased male fertility) as described herein. For example, in some such embodiments, the marker/nonnaturally occurring plant or plant part comprises at least 2, 3, 4, 5, 6, 7, 8, 9, 10, 11, 12, 13, 14, 15, 20, 25, 30, 35, 40, 45, 50, 55, 60, 65, 70, 75, 80, 85, 90, 95, 100, 110, 120, 130, 140 or more alleles, haplotypes, molecules of interest (as described herein) associated with increased pollen production, increased pollen production per tassel, increased pollen production per anther, improved pollen morphology, increased anther production per plant, increased anther production per tassel, improved anther morphology, increased tassel production per plant, improved tassel morphology, increased fertility (e.g., increased male fertility) under stress conditions (e.g., drought conditions), increased fertility (e.g., increased male fertility) under elevated daytime temperatures, increased fertility (e.g., increased male fertility) under elevated nighttime temperatures and/or increased fertility (e.g., increased male fertility) under conditions comprising a large differential between daytime temperatures and nighttime temperatures.

Nonnaturally occurring plants of the present invention may comprise any suitable insecticidal protein, including, but not limited to Vip3 proteins.

In some embodiments, the nonnaturally occurring plant or plant part comprises one or more nucleic acids encoding a Vip3 protein. For example, in some embodiments, the nonnaturally occurring plant or plant part comprises the maize MIR162 event, optionally in a hemizygous or homozygous state. In embodiments, the nonnaturally occurring plant or plant part is an inbred line (e.g., a male inbred line) or a double haploid line. In embodiments, the nonnaturally occurring plant or plant part is from an elite maize line. In embodiments, the nonnaturally occurring plant or plant part is from a cultivated plant or plant part. In some embodiments, the nonnaturally occurring plant or plant part comprises one or more Vip nucleotide sequences of as set forth by the Accession Numbers provided in Table 4.

TABLE 4

Examples of Vip3 proteins.

| Name | GenBank Accession No. | GenBank Accession No. | Publication(s) |
|---|---|---|---|
| Vip3Aa1 | L48811 | AAC37036 | International Patent Pub. No. WO2013015993 |
| Vip3Aa2 | L48812 | AAC37037 | International Patent Pub. No. WO2013015993 |
| Vip3Aa3 | | | U.S. Pat. No. 6,137,033; International Patent Pub. No. WO2013015993 |
| Vip3Aa4 | | AAR81079 | U.S. Pat. No. 6,656,908; International Patent Pub. No. WO2013015993 |
| Vip3Aa5 | | AAR81080 | U.S. Pat. No. 6,656,908; International Patent Pub. No. WO2013015993 |
| Vip3Aa6 | | AAR81081 | U.S. Pat. No. 6,656,908; International Patent Pub. No. WO2013015993 |
| Vip3Aa7 | AY044227 | AAK95326 | International Patent Pub. No. WO2013015993 |
| Vip3Aa8 | AF399667 | AAK97481 | International Patent Pub. No. WO2013015993 |
| Vip3Aa9 | Y17158 | CAA76665 | International Patent Pub. No. WO2013015993 |
| Vip3Aa10 | AF373030 | AAN60738 | International Patent Pub. No. WO2013015993 |
| Vip3Aa11 | AY489126 | AAR36859 | International Patent Pub. No. WO2013015993 |
| Vip3Aa12 | AF500478 | AAM22456 | International Patent Pub. No. WO2013015993 |
| Vip3Aa13 | AY074706 | AAL69542 | International Patent Pub. No. WO2013015993 |
| Vip3Aa14 | AF548629 | AAQ12340 | International Patent Pub. No. WO2013015993 |
| Vip3Aa15 | AY295778 | AAP51131 | International Patent Pub. No. WO2013015993 |
| Vip3Aa16 | AY739665 | AAW65132 | International Patent Pub. No. WO2013015993 |
| Vip3Aa17 | | | U.S. Pat. No. 6,603,063 |
| Vip3Aa18 | AY945939 | AAX49395 | International Patent Pub. No. WO2013015993 |

TABLE 4-continued

Examples of Vip3 proteins.

| Name | GenBank Accession No. | GenBank Accession No. | Publication(s) |
|---|---|---|---|
| Vip3Aa19 | DQ241674 | ABB72459 | International Patent Pub. No. WO2013015993 |
| Vip3Aa19 | DQ539887 | ABG20428 | International Patent Pub. No. WO2013015993 |
| Vip3Aa20 | DQ539888 | ABG20429 | International Patent Pub. No. WO2013015993 |
| Vip3Aa21 | DQ426899 | ABD84410 | International Patent Pub. No. WO2013015993 |
| Vip3Aa22 | DQ016968 | AAY41427 | International Patent Pub. No. WO2013015993 |
| Vip3Aa23 | DQ016969 | AAY41428 | International Patent Pub. No. WO2013015993 |
| Vip3Aa24 | EF432794 | ABO20895 | International Patent Pub. No. WO2013015993 |
| Vip3Aa25 | EF608501 | ABR22260 | International Patent Pub. No. WO2013015993 |
| Vip3Aa26 | EU294496 | ABX90027 | International Patent Pub. No. WO2013015993 |
| Vip3Aa27 | EU332167 | ABY51679 | International Patent Pub. No. WO2013015993 |
| Vip3Aa28 | FJ494817 | ACR15110 | International Patent Pub. No. WO2013015993 |
| Vip3Aa29 | FJ626674 | ACV04598 | International Patent Pub. No. WO2013015993 |
| Vip3Aa30 | FJ626675 | ACV04599 | International Patent Pub. No. WO2013015993 |
| Vip3Aa31 | FJ626676 | ACV04600 | International Patent Pub. No. WO2013015993 |
| Vip3Aa32 | FJ626677 | ACV04601 | International Patent Pub. No. WO2013015993 |
| Vip3Aa33 | GU073128 | ACY38212 | International Patent Pub. No. WO2013015993 |
| Vip3Aa34 | GU073129 | ACY38213 | International Patent Pub. No. WO2013015993 |
| Vip3Aa35 | GU733921 | ADE06071 | International Patent Pub. No. WO2013015993 |
| Vip3Aa36 | GU951510 | ADF43020 | International Patent Pub. No. WO2013015993 |
| Vip3Aa37 | HM132041 | ADJ18213 | International Patent Pub. No. WO2013015993 |
| Vip3Aa38 | HM117632 | AEH31411 | International Patent Pub. No. WO2013015993 |
| Vip3Aa39 | HM117631 | AEH31410 | International Patent Pub. No. WO2013015993 |
| Vip3Aa40 | HM132042 | ADJ18214 | International Patent Pub. No. WO2013015993 |
| Vip3Aa41 | HM132043 | ADJ18215 | International Patent Pub. No. WO2013015993 |
| Vip3Aa42 | HQ587048 | ADQ73634 | International Patent Pub. No. WO2013015993 |
| Vip3Aa43 | HQ594534 | ADY76643 | International Patent Pub. No. WO2013015993 |
| Vip3Aa44 | HQ650163 | ADW66453 | International Patent Pub. No. WO2013015993 |
| Vip3Ab1 | | AAR40284 | U.S. Pat. No. 6,603,063; International Patent Publ. No. WO2013015993 |
| Vip3Ab2 | DQ054848 | AAY88247 | International Patent Publication No. WO2013015993 |
| Vip3Ac1 | | | International Patent Pub. No. WO2013015993 |
| Vip3Ad1 | | | U.S. Patent Pub. No. 2004/0128716; International Patent Pub. No. WO2013015993 |
| Vip3Ad2 | AJ872071 | CAI43276 | International Patent Pub. No. WO2013015993 |
| Vip3Ae1 | AJ872072 | CAI43277 | International Patent Pub. No. WO2013015993 |
| Vip3Af1 | AJ872070 | CAI43275 | International Patent Pub. No. WO2013015993 |
| Vip3Af2 | | ADN08753 | International Patent Pub. No. WO2013015993 |

TABLE 4-continued

Examples of Vip3 proteins.

| Name | GenBank Accession No. | GenBank Accession No. | Publication(s) |
|---|---|---|---|
| Vip3Af3 | HM117634 | AEH31413 | International Patent Pub. No. WO2013015993 |
| Vip3Af4 | | | International Patent Pub. No. WO2013015993 |
| Vip3Af5 | | | International Parent Pub. No. WO2013015993 |
| Vip3Ag1 | | ADN08758 | International Patent Pub. No. WO2013015993 |
| Vip3Ag2 | FJ556803 | ACL97352 | International Patent Pub. No. WO2013015993 |
| Vip3Ag3 | HM117633 | AEH31412 | International Patent Pub. No. WO2013015993 |
| Vip3Ag4 | HQ414237 | ADZ46177 | International Patent Pub. No. WO2013015993 |
| Vip3Ag5 | HQ542193 | ADY76642 | International Patent Pub. No. WO2013015993 |
| Vip3Ah1 | DQ832323 | ABH10614 | International Patent Pub. No. WO2013015993 |
| Vip3Ba1 | AY823271 | AAV70653 | |
| Vip3Bb1 | | ADN08760 | |
| Vip3Bb2 | EF439819 | ABO30520 | |
| Vip3B-like | HM016910 | ADI48120 | |

In some embodiments, the nonnaturally occurring plant or plant part comprises at least one nucleotide sequence that is at least about 75%, 80%, 85%, 90%, 95%, 96%, 97%, 98%, 99%, 99.5% or more identical to one or more of the Vip nucleotide sequences of as set forth by the accession numbers provided in Table 4.

In some embodiments, the nonnaturally occurring plant or plant part comprises at least one nucleotide sequence that specifically hybridizes to the nucleotide sequence of one or more of Vip nucleotide sequences of as set forth by the accession numbers provided in Table 4 under stringent hybridization conditions.

In some embodiments, the nonnaturally occurring plant or plant part comprises at least one nucleotide sequence that encodes the amino acid sequence set forth in one or more of Vip nucleotide sequences of as set forth by the accession numbers provided in Table 4.

In some embodiments, the nonnaturally occurring plant or plant part comprises at least one nucleotide sequence that encodes an amino acid sequence that is at least about 75%, 80%, 85%, 90%, 95%, 96%, 97%, 98%, 99%, 99.5% or more identical to the amino acid sequence set forth in one or more of Vip nucleotide sequences of as set forth by the accession numbers provided in Table 4.

The present invention also provides nonnaturally occurring nucleic acids. As used herein with respect to nucleic acids, the term "nonnaturally occurring" refers to nucleic acids that do not naturally exist in nature. In some embodiments, a nonnaturally occurring nucleic acid does not naturally exist in nature because it is not in the genetic background of the cell/organism in which it naturally resides. That is, the nonnaturally occurring nucleic acid is substantially modified by deliberate human intervention from its native form in composition (e.g., comprised in a heterologous/recombinant expression cassette with one or more heterologous promoter sequences, intron sequences and/or termination sequences) and/or is located at a non-native genomic locus. Thus, nonnaturally occurring plants, and plant parts of the present invention may comprise one more exogenous or heterologous nucleotide sequences and/or one or more nonnaturally occurring copies of a naturally occurring nucleotide sequence (i.e., extraneous copies of a gene that naturally occurs in that species). In some embodiments, the nonnaturally occurring nucleic acid molecules of the invention may comprise any suitable variation(s) from their closest naturally occurring counterparts. For example, nonnaturally occurring nucleic acid molecules of the present invention may comprise an otherwise naturally occurring nucleotide sequence having one or more point mutations, insertions or deletions relative to the naturally occurring nucleotide sequence.

Nonnaturally occurring nucleic acids of the present invention may comprise any suitable marker/allele of interest, including, but not limited to, those described herein.

In some embodiments, the nonnaturally occurring nucleic acid comprises, consists essentially of or consists of one or more of the chromosomal segments described in Table 1. For example, the nonnaturally occurring nucleic acid may comprise, consist essentially of or consist of one or more of chromosomal segments 46 to 12473 (e.g., within chromosomal segment 7514).

In some embodiments, the nonnaturally occurring nucleic acid comprises, consists essentially of or consists of one or more nucleic acid sequences derived from NP2222 maize germplasm. For example, the nonnaturally occurring nucleic acid may comprise, consist essentially of or consist of one or more of the chromosomal segments described in Table 1, wherein the chromosomal segment is at least about 75%, 80%, 85%, 90%, 95%, 96%, 97%, 98%, 99%, 99.5% or more identical to the corresponding segment(s) of NP2222 maize germplasm. In some such embodiments, the nonnaturally occurring nucleic acid comprises, consists essentially of or consists of one or more of chromosomal segments 3 to 12768, (e.g., chromosomal segments 3, 13, 25, 506, 7514, 7546, 12747, 12753, 12760-12761 and/or 12767-12768) of NP2222 maize germplasm, the reverse complement thereof, an informative fragment thereof, or an informative fragment of the reverse complement thereof.

In some embodiments, the nonnaturally occurring nucleic acid comprises, consists essentially of or consists of one or more nucleic acid sequences derived from NP2660 maize germplasm. For example, the nonnaturally occurring nucleic acid may comprise, consist essentially of or consist of one or more of the chromosomal segments described in Table 1, wherein the chromosomal segment is at least about 75%, 80%, 85%, 90%, 95%, 96%, 97%, 98%, 99%, 99.5% or more identical to the corresponding segment(s) of NP2660 maize germplasm. In some such embodiments, the nonnaturally occurring nucleic acid comprises, consists essentially of or consists of one or more of chromosomal segments 3 to 12743 and/or one or more of chromosomal segments 12757 to 12768, (e.g., chromosomal segments 3, 13, 25, 506, 7514, 7546, 12747, 12753, 12760-12761 and/or 12767-12768) of NP2660 maize germplasm, the reverse complement thereof, an informative fragment thereof, or an informative fragment of the reverse complement thereof.

In some embodiments, the nonnaturally occurring nucleic acid comprises, consists essentially of or consists of one or more nucleic acid sequences derived from NP2276 maize germplasm. For example, the nonnaturally occurring nucleic acid may comprise, consist essentially of or consist of one or more of the chromosomal segments described in Table 1, wherein the chromosomal segment is at least about 75%, 80%, 85%, 90%, 95%, 96%, 97%, 98%, 99%, 99.5% or more identical to the corresponding segment(s) of NP2276 maize germplasm. In some such embodiments, the nonnaturally occurring nucleic acid comprises, consists essentially of or consists of chromosomal segment 1, one or more of chromosomal segments 46 to 12743 and/or one or more of chromosomal segments 12757 to 12768, (e.g., chromosomal segments 13, 506, 7514, 7546 and/or 12760-12761) of NP2276 maize germplasm, the reverse complement thereof, an informative fragment thereof, or an informative fragment of the reverse complement thereof.

In some embodiments, the nonnaturally occurring nucleic acid comprises, consists essentially of or consists of one or more nucleic acid sequences derived from ID3461 maize germplasm. For example, the nonnaturally occurring nucleic acid may comprise, consist essentially of or consist of one or more of the chromosomal segments described in Table 1, wherein the chromosomal segment is at least about 75%, 80%, 85%, 90%, 95%, 96%, 97%, 98%, 99%, 99.5% or more identical to the corresponding segment(s) of ID3461 maize germplasm. In some such embodiments, the nonnaturally occurring nucleic acid comprises, consists essentially of or consists of one or more of chromosomal segments 1 to 17 (e.g., chromosomal segments 1 and/or 13) of ID3461 maize germplasm, the reverse complement thereof, an informative fragment thereof, or an informative fragment of the reverse complement thereof.

In embodiments, the nonnaturally occurring nucleic acid comprises, consists essentially of or consists of one or more nucleic acid sequences derived from a line in Table 11.

In some embodiments, the nonnaturally occurring nucleic acid comprises, consists essentially of or consists of one or more nucleotide sequences that is at least about 75%, 80%, 85%, 90%, 95%, 96%, 97%, 98%, 99%, 99.5% or more identical to one or more of the nucleotide sequences set forth in SEQ ID NOs: 1 to 350 and Vip polypeptides (as described in Tables 3 and 4), the reverse complement thereof, an informative fragment thereof, or an informative fragment of the reverse complement thereof.

In some embodiments, the nonnaturally occurring nucleic acid comprises, consists essentially of or consists of at least one nucleotide sequence that encodes an amino acid sequence that is at least about 75%, 80%, 85%, 90%, 95%, 96%, 97%, 98%, 99%, 99.5% or more identical to the amino acid sequence set forth in one or more of SEQ ID NOs: 351 to 525 (as described in Table 3).

In some embodiments, the nonnaturally occurring nucleic acid comprises one or more of the desired alleles described in Table 2. For example, in some embodiments, the isolated nucleic acid sequence comprises 2, 3, 4, 5, 6, 7, 8, 9, 10, 11, 12, 13, 14, 15, 20, 25, 30, 35, 40, 45, 50, 55, 60, 65, 70, 75, 80, 85, 90, 95, 100, 110, 120, 130, 140 or more of the desired alleles described in Table 2.

In embodiments, the nonnaturally occurring nucleic acid comprises one or more of the desired alleles described in Table 8. For example, in some embodiments, the nonnaturally occurring nucleic acid comprises at least about 2, 3, 4, 5, 6, 7, 8, 9, 10, 11, 12, 13, 14, 15, 16, 17 or more, or all 18 of the desired alleles described in Table 8.

In embodiments, the nonnaturally occurring nucleic acid comprises one or more of the desired alleles:
  (a) on chromosome 5 (QTL 5.1 and/or QTL 5.2) as described in Table 8;
  (b) on chromosome 3 as described in Table 8;
  (c) on chromosome 7 as described in Table 8;
  (d) on chromosome 10 as described in Table 8;
  (e) on chromosomes 3 and 5 as described in Table 8;
  (f) on chromosomes 5 and 7 as described in Table 8;
  (g) on chromosomes 3, 5 and 7 as described in Table 8;
  (h) on chromosomes 5 and 10 as described in Table 8;
  (i) on chromosomes 3, 5 and 10 as described in Table 8; or
  (j) any combination of (a) to (i).

In embodiments, the nonnaturally occurring nucleic acid comprises one or more of the desired alleles described in Table 10. For example, in some embodiments, the nonnaturally occurring nucleic acid comprises 2, 3, 4, 5, 6, 7, 8, 9, 10, 11, 12, 13, 14, 15, 20, 25 or more of the desired alleles described in Table 10.

In some embodiments, the nonnaturally occurring nucleic acid comprises codons specific for expression in plants.

In some embodiments, the nonnaturally occurring nucleic acid is an isolated nucleic acid.

In some embodiments, the nonnaturally occurring nucleic acid comprises one or more detectable moieties, such as digoxigenin, fluorescein, acridine-ester, biotin, alkaline phosphatase, horseradish peroxidase, β-glucuronidase, β-galactosidase, luciferase, ferritin or a radioactive isotope. See, e.g., Prober et al. SCIENCE 238:336-340 (1987); European Patent Nos. 144914 and 119448; and U.S. Pat. Nos. 4,582,789 and 4,563,417.

Nonnaturally occurring nucleic acids of the present invention may comprise any suitable transgene(s), including, but not limited to, transgenes that encode gene products that provide herbicide-resistance, pest-resistance (e.g., a vip3 transgene) and/or disease-resistance.

In some embodiments, the nonnaturally occurring nucleic acid comprises one or more transgenes encoding a gene product that provides resistance to one or more herbicides. For example, the nonnaturally occurring nucleic acid may comprise a transgene that encodes a gene product that provides glyphosate-, sulfonylurea-, imidazolinione-, dicamba-, glufisinate-, phenoxy proprionic acid-, cycloshexome-, traizine-, benzonitrile-, and/or broxynil-resistance.

In some embodiments, the nonnaturally occurring nucleic acid comprises one or more transgenes encoding a gene product that provides resistance to one or more pests. For example, the nonnaturally occurring nucleic acid may comprise a transgene that encodes a gene product that provides bacterial-, fungal, gastropod-, insect-, nematode-, oomycete-, phytoplasma-, protozoa-, and/or viral-resistance.

In some embodiments, the nonnaturally occurring nucleic acid comprises one or more transgenes encoding a gene product that provides resistance to one or more diseases.

Nonnaturally occurring nucleic acids of the present invention may comprise any suitable number of nucleic acids. In some embodiments, the nonnaturally occurring nucleic acid is 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, 75, 80, 85, 90, 95, 100, 125, 150, 175, 200, 225, 250, 275, 300, 325, 350, 375, 400, 450, 500 or more nucleotides in length. In some embodiments, the nonnaturally occurring nucleic acid is less than about 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, 75, 80, 85, 90, 95, 100, 125, 150, 175, 200, 225, 250, 275, 300, 325, 350, 375, 400, 450 or 500 nucleotides in length. In some embodiments, the nonnaturally occurring nucleic acid is about 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, 75, 80, 85, 90, 95, 100, 125, 150, 175, 200, 225, 250, 275, 300, 325, 350, 375, 400, 450 or 500 nucleotides in length.

The present invention also provides expression cassettes comprising one or more nonnaturally occurring nucleic acids of the present invention. In some embodiments, the expression cassette comprises a nucleic acid encoding a polypeptide that confers at least one property (e.g., resistance to a selection agent) that can be used to detect, identify or select transformed plant cells and tissues.

The present invention also provides vectors comprising one or more nonnaturally occurring nucleic acids and/or expression cassettes of the present invention.

The present invention also extends to compositions comprising nonnaturally occurring nucleic acids, expression cassettes and/or vectors of the present invention.

The present invention extends to uses of nonnaturally occurring nucleic acids, expression cassettes and vectors of the present invention, including, but not limited to, methods of identifying, selecting and/or producing fertile maize plants; predicting whether and/or to what extent a maize plant will be fertile; reducing the costs associated with breeding and/or seed production programs; and/or to increasing the efficiency of breeding and/or seed production programs.

The present invention also provides primers for amplifying nucleic acid sequences comprising one or more markers associated with increased fertility (e.g., one or more markers of the present invention).

Primers of the present invention may comprise any nucleic acid sequence useful for amplifying one or more markers associated with increased fertility (e.g., one or more markers of the present invention).

In some embodiments, the primer comprises nucleic acid sequences useful for amplifying one or more of the chromosomal segments described in Table 1. For example, in some embodiments, the primer pair comprises nucleotide sequences useful for amplifying one or more of chromosomal segments 46 to 12473 (e.g., chromosomal segment 7514).

The present invention extends to compositions comprising primers of the present invention. In some embodiments, the composition comprises a pair of primers, wherein each of the primers is a primer of the present invention.

The present invention also provides amplification products comprising one or more markers/alleles associated with increased fertility (e.g., one or more markers/alleles associated with increased male fertility).

Amplification products of the present invention may be derived from any suitable chromosomal segment(s).

In some embodiments, the amplification product is derived from one or more of the chromosomal segments described in Table 1. For example, in some embodiments, the amplification product is derived from one or more of chromosomal segments 46 to 12473 (e.g., chromosomal segment 7514).

Amplification products of the present invention may comprise any suitable allele(s) of interest.

In some embodiments, the amplification product comprises, consists essentially of or consists of one or more nucleic acid sequences derived from NP2222 maize germplasm. For example, the amplification product may comprise, consist essentially of or consist of one or more of the chromosomal segments described in Table 1 (e.g., chromosomal segments 3, 13, 25, 506, 7514, 7546, 12747, 12753, 12760-12761 and/or 12767-12768), wherein the chromosomal segment is at least about 75%, 80%, 85%, 90%, 95%, 96%, 97%, 98%, 99%, 99.5% or more identical to the corresponding segment(s) of NP2222 maize germplasm.

In some embodiments, the amplification product comprises, consists essentially of or consists of one or more nucleic acid sequences derived from NP2660 maize germplasm. For example, the amplification product may comprise, consist essentially of or consist of one or more of the chromosomal segments described in Table 1 (e.g., chromosomal segments 3, 13, 25, 506, 7514, 7546, 12747, 12753, 12760-12761 and/or 12767-12768), wherein the chromosomal segment is at least about 75%, 80%, 85%, 90%, 95%, 96%, 97%, 98%, 99%, 99.5% or more identical to the corresponding segment(s) of NP2660 maize germplasm.

In some embodiments, the amplification product comprises, consists essentially of or consists of one or more nucleic acid sequences derived from NP2276 maize germplasm. For example, the amplification product may comprise, consist essentially of or consist of one or more of the chromosomal segments described in Table 1 (e.g., chromosomal segments 1, 182, 184, 10230, 10259 and/or 10276-10277), wherein the chromosomal segment is at least about 75%, 80%, 85%, 90%, 95%, 96%, 97%, 98%, 99%, 99.5% or more identical to the corresponding segment(s) of NP2276 maize germplasm.

In some embodiments, the amplification product comprises, consists essentially of or consists of one or more nucleic acid sequences derived from ID3461 maize germplasm. For example, the amplification product may comprise, consist essentially of or consist of one or more of chromosomal segments 1 to 17 described in Table 1 (e.g., chromosomal segments 1 and/or 13), wherein the chromosomal segment is at least about 75%, 80%, 85%, 90%, 95%, 96%, 97%, 98%, 99%, 99.5% or more identical to the corresponding segment(s) of ID3461 maize germplasm.

In embodiments, the amplification product comprises, consists essentially of or consists of one or more nucleic acid sequences derived from a line in Table 11.

In some embodiments, the amplification product comprises, consists essentially of or consists of at least one nucleotide sequence of SEQ ID NOs: 1 to 350, the reverse complement thereof, an informative fragment thereof, or an informative fragment of the reverse complement thereof.

In some embodiments, the amplification product comprises, consists essentially of or consists of at least one nucleotide sequence that is at least about 75%, 80%, 85%, 90%, 95%, 96%, 97%, 98%, 99%, 99.5% or more identical to one or more of SEQ ID NOs: 1 to 350, the reverse complement thereof, an informative fragment thereof or an informative fragment of the reverse complement thereof.

In some embodiments, the amplification product comprises, consists essentially of or consists of at least one nucleotide sequence that specifically hybridizes to the nucleotide sequence of one or more of SEQ ID NOs: 1 to 350, the reverse complement thereof, an informative fragment thereof or an informative fragment of the reverse complement thereof under stringent hybridization conditions.

In some embodiments, the amplification product comprises, consists essentially of or consists of at least one nucleotide sequence that encodes the amino acid sequence set forth in one or more of SEQ ID NOs: 351 to 525 (as described in Table 3).

In some embodiments, the amplification product comprises, consists essentially of or consists of at least one nucleotide sequence that encodes an amino acid sequence that is at least about 75%, 80%, 85%, 90%, 95%, 96%, 97%, 98%, 99%, 99.5% or more identical to the amino acid sequence set forth in one or more of SEQ ID NOs: 351 to 525 (as described in Table 3).

In some embodiments, the amplification product comprises, consists essentially of or consists of at least one of SEQ ID NOs: 526 to 613 (as described in Table 9), the reverse complement thereof, an informative fragment thereof or an informative fragment of the reverse complement thereof.

In some embodiments, the amplification product comprises, consists essentially of or consists of at least one nucleotide sequence that is at least about 75%, 80%, 85%, 90%, 95%, 96%, 97%, 98%, 99%, 99.5% or more identical to one or more of SEQ ID NOs: 526 to 613 (as described in Table 9), the reverse complement thereof, an informative fragment thereof or an informative fragment of the reverse complement thereof.

In some embodiments, amplification product comprises, consists essentially of or consists of at least one nucleotide sequence that specifically hybridizes to the nucleotide sequence of one or more of SEQ ID NOs: 526 to 613 (as described in Table 9), the reverse complement thereof, an informative fragment thereof or an informative fragment of the reverse complement thereof under stringent hybridization conditions.

In some embodiments, the amplification product comprises, consists essentially of or consists of one or more of the desired alleles described in Table 2 or the reverse complement thereof. For example, in some embodiments, the amplification product comprises, consists essentially of or consists of at least about 2, 3, 4, 5, 6, 7, 8, 9, 10, 11, 12, 13, 14, 15, 20, 25, 30, 35, 40, 45, 50, 55, 60, 65, 70, 75, 80, 85, 90, 95, 100, 110, 120, 130, 140 or more of the desired alleles described in Table 2.

In embodiments, the amplification product comprises one or more of the desired alleles described in Table 8. For example, in some embodiments, the amplification product comprises at least about 2, 3, 4, 5, 6, 7, 8, 9, 10, 11, 12, 13, 14, 15, 16, 17 or more, or all 18 of the desired alleles described in Table 8.

In embodiments, the amplification product comprises one or more of the desired alleles:

(a) on chromosome 5 (QTL 5.1 and/or QTL 5.2) as described in Table 8;
(b) on chromosome 3 as described in Table 8;
(c) on chromosome 7 as described in Table 8;
(d) on chromosome 10 as described in Table 8;
(e) on chromosomes 3 and 5 as described in Table 8;
(f) on chromosomes 5 and 7 as described in Table 8;
(g) on chromosomes 3, 5 and 7 as described in Table 8;
(h) on chromosomes 5 and 10 as described in Table 8;
(i) on chromosomes 3, 5 and 10 as described in Table 8; or
(j) any combination of (a) to (i).

In some embodiments, the amplification product comprises one or more of the desired alleles described in Table 10. For example, in some embodiments, the amplification product comprises at least about 2, 3, 4, 5, 6, 7, 8, 9, 10, 11, 12, 13, 14, 15, 20, 25 or more of the desired alleles described in Table 10.

In some embodiments, the amplification product comprises one or more detectable moieties, such as digoxigenin, fluorescein, acridine-ester, biotin, alkaline phosphatase, horseradish peroxidase, β-glucuronidase, β-galactosidase, luciferase, ferritin or a radioactive isotope. See, e.g., Prober et al. SCIENCE 238:336-340 (1987); European Patent Nos. 144914 and 119448; and U.S. Pat. Nos. 4,582,789 and 4,563,417.

Amplification products of the present invention may be derived using any suitable primers.

Amplification products of the present invention may be generated using any suitable technique(s), including, but not limited to, polymerase chain reaction (PCR) (e.g., Mullis et al. COLD SPRING HARBOR SYMP. QUANT. BIOL. 51:263-273 (1986); European Patent Nos. 50,424; 84,796; 258,017; 237,362 and 201,184; U.S. Pat. Nos. 4,683,202; 4,582,788 and 4,683,194).

The present invention also provides isolated and purified marker probes (as described in Table 9).

Marker probes (as described in Table 9) of the present invention may be directed against any suitable allele(s), haplotype(s) and/or molecule(s) of interest.

In some embodiments, the marker probe is directed against a chromosomal segment of NP2222 maize germplasm. For example, the marker probe may be directed against one or more of chromosomal segments 3 to 12768 as described in Table 1, (e.g., chromosomal segments 3, 13, 25, 506, 7514, 7546, 12747, 12753, 12760-12761 and/or 12767-12768) of NP2222 maize germplasm, the reverse complement thereof, an informative fragment thereof or an informative fragment of the reverse complement thereof.

In some embodiments, the marker probe is directed against a chromosomal segment of NP2660 maize germplasm. For example, the marker probe may be directed against one or more of chromosomal segments 3 to 12743 and/or one or more of chromosomal segments 12757 to 12768, (as described in Table 1; e.g., chromosomal segments 3, 13, 25, 506, 7514, 7546, 12747, 12753, 12760-12761 and/or 12767-12768) of NP2660 maize germplasm, the reverse complement thereof, an informative fragment thereof or an informative fragment of the reverse complement thereof.

In some embodiments, the marker probe is directed against a chromosomal segment of NP2276 maize germplasm. For example, the marker probe may be directed against chromosomal segment 1 as described in Table 1, one or more of chromosomal segments 46 to 12743 and/or one or more of chromosomal segments 12757 to 12768, (e.g., chromosomal segments 13, 506, 7514, 7546 and/or 12760-12761) of NP2276 maize germplasm, the reverse complement thereof, an informative fragment thereof or an informative fragment of the reverse complement thereof. In some embodiments, the marker probe is directed against a chromosomal segment of ID3461 maize germplasm. For example, the marker probe may be directed against one or more of chromosomal segments 1 to 17 of Table 1 (e.g., chromosomal segments 1 and/or 13) of ID3461 maize germplasm, the reverse complement thereof, an informative fragment thereof or an informative fragment of the reverse complement thereof.

In embodiments, the marker probe is directed against a chromosomal segment of a line in Table 11, for example, the marker probe may be directed against one or more of the chromosomal segments described in Table 1, the reverse complement thereof, an informative fragment thereof or an informative fragment of the reverse complement thereof.

In some embodiments, the marker probe is directed against a nucleotide sequence that is at least about 75%, 80%, 85%, 90%, 95%, 96%, 97%, 98%, 99%, 99.5% or more identical to one or more of the nucleotide sequences set forth in SEQ ID NOs: 1 to 350 as described in Table 3 and in the VIP accession numbers described in Table 4, the reverse complement thereof, or an informative fragment thereof.

In some embodiments, the marker probe is directed against one or more nucleotide sequences that encode an amino acid sequence that is at least about 75%, 80%, 85%, 90%, 95%, 96%, 97%, 98%, 99%, 99.5% or more identical to one or more of the amino acid sequences set forth in SEQ ID NOs: 351 to 525 (as described in Table 3), the reverse complement thereof, or an informative fragment thereof.

In some embodiments, the marker probe is directed against a nucleotide sequence that comprises one or more of the desired alleles described in Table 2. For example, in some embodiments, the marker probe is directed against a nucleotide sequence that comprises 2, 3, 4, 5, 6, 7, 8, 9, 10, 11, 12, 13, 14, 15, 20, 25, 30, 35, 40, 45, 50, 55, 60, 65, 70, 75, 80, 85, 90, 95, 100, 110, 120, 130, 140 or more of the desired alleles described in Table 2.

In embodiments, the marker probe is directed against a nucleotide sequence that comprises one or more of the desired alleles described in Table 8. For example, in some embodiments, the marker probe is directed against a nucleotide sequence that comprises at least about 2, 3, 4, 5, 6, 7, 8, 9, 10, 11, 12, 13, 14, 15, 16, 17 or more, or all 18 of the desired alleles described in Table 8 (see, e.g., the exemplary probes described in Table 9).

In embodiments, the marker probe is directed against a nucleotide sequence that comprises one or more of the desired alleles:

(a) on chromosome 5 (QTL 5.1 and/or QTL 5.2) as described in Table 8;

(b) on chromosome 3 as described in Table 8;

(c) on chromosome 7 as described in Table 8;

(d) on chromosome 10 as described in Table 8;

(e) on chromosomes 3 and 5 as described in Table 8;

(f) on chromosomes 5 and 7 as described in Table 8;

(g) on chromosomes 3, 5 and 7 as described in Table 8;

(h) on chromosomes 5 and 10 as described in Table 8;

(i) on chromosomes 3, 5 and 10 as described in Table 8; or (j) any combination of (a) to (i).

In some embodiments, the marker probe is directed against a nucleotide sequence that comprises one or more of the desired alleles described in Table 10. For example, in some embodiments, the marker probe is directed against a nucleotide sequence that comprises 2, 3, 4, 5, 6, 7, 8, 9, 10, 11, 12, 13, 14, 15, 20, 25 or more of the desired alleles described in Table 10.

In some embodiments, the marker probe is directed against an amino acid sequence that is at least about 75%, 80%, 85%, 90%, 95%, 96%, 97%, 98%, 99%, 99.5% or more identical to one or more of the amino acid sequences set forth in SEQ ID NOs: 351 to 525 (as described in Table 3) or an informative fragment thereof.

In some embodiments, the marker probe comprises, consists essentially of or consists of an amino acid sequence that is at least about 75%, 80%, 85%, 90%, 95%, 96%, 97%, 98%, 99%, 99.5% or more identical to a chromosomal segment of NP2222, the reverse complement thereof, an informative fragment thereof or an informative fragment of the reverse complement thereof. In some such embodiments, the chromosomal segment comprises, consists essentially of or consists of one or more of chromosomal segments 3 to 12768, as described in Table 1 (e.g., chromosomal segments 3, 13, 25, 506, 7514, 7546, 12747, 12753, 12760-12761 and/or 12767-12768).

In some embodiments, the marker probe comprises, consists essentially of or consists of an amino acid sequence that is at least about 75%, 80%, 85%, 90%, 95%, 96%, 97%, 98%, 99%, 99.5% or more identical to a chromosomal segment of NP2660, the reverse complement thereof, an informative fragment thereof or an informative fragment of the reverse complement thereof. In some such embodiments, the chromosomal segment comprises, consists essentially of or consists of one or more of chromosomal segments 3 to 12743 and/or one or more of chromosomal segments 12757 to 12768, as described in Table 1 (e.g., chromosomal segments 3, 13, 25, 506, 7514, 7546, 12747, 12753, 12760-12761 and/or 12767-12768).

In some embodiments, the marker probe comprises, consists essentially of or consists of an amino acid sequence that is at least about 75%, 80%, 85%, 90%, 95%, 96%, 97%, 98%, 99%, 99.5% or more identical to a chromosomal segment of NP2276, the reverse complement thereof, an informative fragment thereof or an informative fragment of the reverse complement thereof. In some such embodiments, the chromosomal segment comprises, consists essentially of or consists of chromosomal segment 1, one or more of chromosomal segments 46 to 12743 and/or one or more of chromosomal segments 12757 to 12768, as described in Table 1 (e.g., chromosomal segments 13, 506, 7514, 7546 and/or 12760-12761

In some embodiments, the marker probe comprises, consists essentially of or consists of an amino acid sequence that is at least about 75%, 80%, 85%, 90%, 95%, 96%, 97%, 98%, 99%, 99.5% or more identical to a chromosomal segment of ID3461, the reverse complement thereof, an informative fragment thereof or an informative fragment of the reverse complement thereof. In some such embodiments, the chromosomal segment comprises, consists essentially of or consists of one or more of chromosomal segments 1 to 17 as described in Table 1 (e.g., chromosomal segments 1 and/or 13).

For example, the marker probe may be directed against one or more of chromosomal segments 1 to 17 as described in Table 1 (e.g., chromosomal segments 1 and/or 13) of ID3461 maize germplasm, the reverse complement thereof, an informative fragment thereof or an informative fragment of the reverse complement thereof.

In embodiments, the marker probe is directed against one or more chromosomal segments of a line in Table 11.

In some embodiments, the marker probe comprises, consists essentially of or consists of an amino acid sequence that is at least about 75%, 80%, 85%, 90%, 95%, 96%, 97%, 98%, 99%, 99.5% or more identical to one or more of SEQ ID NOs: 1 to 350, the reverse complement thereof, an informative fragment thereof or an informative fragment of the reverse complement thereof.

In some embodiments, the marker probe comprises, consists essentially of or consists of a nucleotide sequence that encodes an amino acid sequence that is at least about 75%, 80%, 85%, 90%, 95%, 96%, 97%, 98%, 99%, 99.5% or more identical to the amino acid sequence set forth in one or more of SEQ ID NOs: 351 to 525 (as described in Table 3).

In some embodiments, the marker probe comprises, consists essentially of or consists of an amino acid sequence that is at least about 75%, 80%, 85%, 90%, 95%, 96%, 97%, 98%, 99%, 99.5% or more identical to one or more of SEQ ID NOs: 526 to 613 (as described in Table 9), the reverse complement thereof, an informative fragment thereof or an informative fragment of the reverse complement thereof.

In some embodiments, the marker probe comprises one or more detectable moieties, such as digoxigenin, fluorescein, acridine-ester, biotin, alkaline phosphatase, horseradish peroxidase, β-glucuronidase, β-galactosidase, luciferase, ferritin or a radioactive isotope. See, e.g., Prober et al. SCIENCE 238:336-340 (1987); European Patent Nos. 144914 and 119448; and U.S. Pat. Nos. 4,582,789 and 4,563,417.

The present invention also provides methods of identifying, selecting and/or producing maize plants and plant parts having increased fertility or one or more characteristics associated with increased fertility (e.g., one or more characteristics associated with increased male fertility); methods of predicting fertility (e.g., male fertility) in maize plants and plant parts; breeding methods; methods of reducing the costs associated with a breeding and/or seed production program;

and methods of improving seed or pollen production in a maize plant (e.g., increasing pollen count per anther, tassel and/or plant).

The methods of the invention can be practiced using one or more of any of the markers, alleles, haplotypes, molecules of interest and/or nonnaturally occurring nucleic acids described herein.

Methods of identifying maize plants and plant parts having increased fertility or one or more characteristics associated with increased fertility may comprise, consist essentially of or consist of detecting one or more markers associated with increased fertility (e.g., one or more markers of the present invention as described herein) in a maize plant or plant part (e.g., a maize germplasm or an amplification product from a maize germplasm).

Methods of selecting maize plants and plant parts having increased fertility or one or more characteristics associated with increased fertility may comprise, consist essentially of or consist of detecting one or more markers associated with increased fertility (e.g., one or more markers of the present invention as described herein) in a maize plant or plant part (e.g., a maize germplasm or an amplification product from a maize germplasm) and selecting said maize plant or plant part based upon the presence of said marker(s).

Methods of predicting fertility (e.g., male fertility) in maize plants and plant parts may comprise, consist essentially of or consist of detecting the presence of one or more markers associated with increased fertility (e.g., one or more markers of the present invention) in a maize plant or plant part (e.g., a maize germplasm or an amplification product from a maize germplasm). In some embodiments, the presence of said marker(s) in the genome of said maize plant or plant part is associated with an increase of at least about 5%, 10%, 15%, 20%, 25%, 30%, 35%, 40%, 45%, 50%, 55%, 60%, 65%, 70%, 75% 80%, 85%, 90%, 95%, 100%, 110%, 120%, 130%, 140%, 150%, 160%, 170%, 180%, 190%, 200%, 225%, 250%, 275%, 300% or more in the ratio of functionally fertile plants to infertile plants. For example, in some embodiments, the presence of said marker(s) in the genome of a maize plant or plant part indicates that said maize plant or plant part will likely exhibit increased pollen production, increased pollen production per anther, improved pollen morphology, increased anther production, increased anther production per tassel, improved anther morphology, increased tassel production, improved tassel morphology, increased silk production, improved silk morphology, increased silk production per plant, increased kernel count, improved kernel morphology, increased kernel production per ear, decreased prevalence of kernel abortion, increased kernel production per plant, increased kernel viability, increased fertility under stress conditions (e.g., drought conditions), increased fertility under elevated daytime temperatures and/or increased fertility under elevated nighttime temperatures as compared to a control plant (e.g., one or both of its parents, a near isogenic line lacking a Vip3 protein coding sequence, etc.).

In embodiments of the methods described herein, a plant or part thereof (or an ancestor or progeny plant or part thereof) is phenotyped to confirm the fertility state (e.g., the state of male fertility) or the presence of characteristics associated with fertility.

Breeding methods of the present invention may comprise, consist essentially of or consist of:
(a) detecting one or more markers associated with increased fertility (e.g., one or more markers of the present invention) in a maize plant or plant part (e.g., a maize germplasm or an amplification product from a maize germplasm) and selecting said maize plant or plant part for inclusion in a breeding program based upon the presence of said marker(s); and/or
(b) detecting the absence of one or more markers associated with increased fertility (e.g., one or more markers of the present invention) in a maize plant or plant part (e.g., a maize germplasm or an amplification product from a maize germplasm) and excluding said maize plant or plant part from a breeding program based upon the absence of said marker(s).

In embodiments of the method of (a), the method further comprises crossing the maize plant (or an ancestor, progeny or sibling thereof) with a second maize plant that optionally lacks the marker to produce a progeny maize plant, which optionally comprises the marker. Those skilled in the art will appreciate that in the case of an inbred line, the term "crossing the maize plant" or "crossing the selected maize plant" can refer to an identical or essentially (e.g., at least 95% genetically identical) parent, sibling or progeny plant.

Optionally, the method further comprises phenotyping the maize plant or plant part (or an ancestor or progeny plant or part thereof) to confirm the fertility state (e.g., the state of male fertility) or the presence of characteristics associated with fertility.

Maize plants and plant parts selected for inclusion in the breeding program may be used to produce one or more generations of fertile progeny. In some embodiments, each generation of progeny plants comprises substantially and/or completely fertile maize plants and plant parts.

The invention also encompasses methods for producing a plant having one or more characteristics associated with increased male fertility. In embodiments, the method comprises: selecting from a diverse maize plant population a maize plant comprising a marker, allele, haplotype, genomic region, and the like associated with increased male fertility as described herein; and crossing the maize plant (or an ancestor, progeny or sibling thereof) with itself or a second maize plant to produce a progeny plant comprising the marker/allele/haplotype/genomic region, thereby producing a plant having one or more characteristics associated with increased male fertility. In embodiments, the second maize plant does not comprise the marker/allele/haplotype/genomic region. In embodiments, the marker/allele/haplotype/genomic region is detected in nucleic acid from the first maize plant and/or progeny plant (e.g., in an amplification product from a nucleic acid sample from the maize plant and/or progeny). Optionally, the method further comprises phenotyping the maize plant or plant part (or an ancestor or progeny plant or part thereof) to confirm the fertility state (e.g., the state of male fertility) or the presence of characteristics associated with fertility.

In embodiments, methods of increasing seed production or reducing the costs associated with a breeding and/or seed production program comprise, consisting essentially of, or consisting of:
(a) detecting one or more markers associated with increased fertility (e.g., one or more markers of the present invention) in a maize plant or plant part (e.g., a maize germplasm or an amplification product from a maize germplasm) and selecting said maize plant or plant part for inclusion in the breeding and/or seed production program based upon the presence of said marker(s); and/or
(b) detecting the absence of one or more markers associated with increased fertility (e.g., one or more markers of the present invention) in a maize plant or plant part (e.g., a maize germplasm or an amplification product from a maize germplasm) and excluding said maize plant or plant part from the breeding and/or seed production program based upon the absence of said marker(s).

Optionally, the method further comprises phenotyping the maize plant or plant part (or an ancestor or progeny plant or part thereof) to confirm the fertility state (e.g., the state of male fertility) or the presence of characteristics associated with fertility.

Maize plants and plant parts selected for inclusion in the breeding and/or seed production program may be used to produce one or more generations of fertile progeny. In some embodiments, each generation of progeny plants comprises substantially and/or completely fertile maize plants and plant parts.

Methods of producing maize plants and plant parts having increased fertility or one or more characteristics associated with increased fertility may comprise, consist essentially of or consist of:
- (a) detecting one or more markers associated with increased fertility (e.g., one or more markers of the present invention) in a maize plant or plant part (e.g., a maize germplasm or an amplification product from a maize germplasm) and producing a maize plant from said maize plant or plant part;
- (b) introducing a nucleic acid comprising one or more alleles associated with increased fertility (e.g., one or more alleles associated with increased male fertility) into the genome of a maize plant or plant part and producing a maize plant from said maize plant or plant part;
- (c) introducing a nucleic acid comprising one or more alleles associated with increased fertility (e.g., one or more alleles associated with increased male fertility) into the genome of a maize plant or plant part, detecting said allele(s) in said maize plant or plant part (by detecting said allele(s) or an informative fragment thereof in an amplification product from said maize plant or plant part, for example) and producing a maize plant from said maize plant or plant part;
- (d) introducing a nucleic acid comprising one or more alleles associated with increased fertility (e.g., one or more alleles associated with increased male fertility) into the genome of a maize plant part or plant part, detecting one or more markers linked to said allele(s) in said maize plant part or plant part (by detecting said marker(s) or an informative fragment thereof in an amplification product from said maize plant or plant part, for example) and producing a maize plant from said maize plant or plant part;
- (e) introducing a genomic region comprising one or more transgenes associated with increased fertility (e.g., one or more transgenes associated with increased male fertility) into the genome of a maize plant or plant part and producing a maize plant from said maize plant or plant part;
- (f) introducing a genomic region comprising one or more transgenes associated with increased fertility (e.g., one or more transgenes associated with increased male fertility) into the genome of a maize plant or plant part, detecting said genomic region in said maize plant or plant part (by detecting said transgene(s) or an informative fragment thereof in an amplification product from said maize plant or plant part, for example) and producing a maize plant from said maize plant or plant part; and/or
- (g) introducing a genomic region comprising one or more transgenes associated with increased fertility (e.g., one or more transgenes associated with increased male fertility) into the genome of a maize plant part or plant part, detecting one or more markers linked to said genomic region in said maize plant part or plant part (by detecting said marker(s) or an informative fragment thereof in an amplification product from said maize plant or plant part, for example) and producing a maize plant from said maize plant or plant part.

Optionally, the method further comprises phenotyping the maize plant or plant part (or an ancestor or progeny plant or part thereof) to confirm the fertility state (e.g., the state of male fertility) or the presence of characteristics associated with fertility.

Methods of improving pollen production in a maize plant (e.g., increasing pollen count per anther, tassel and/or plant) may comprise, consist essentially of or consist of:
- (a) introducing a nucleic acid comprising one or more alleles associated with increased fertility (e.g., one or more alleles associated with increased male fertility) into the genome of a maize plant and, optionally, detecting said allele(s) in said maize plant (by detecting said allele(s) or an informative fragment thereof in an amplification product from said maize plant, for example).
- (b) introducing a nucleic acid comprising one or more alleles associated with increased fertility (e.g., one or more alleles associated with increased male fertility) into the genome of a maize plant and, optionally, detecting one or more markers linked to said allele(s) in said maize plant (by detecting said marker(s) or an informative fragment thereof in an amplification product from said maize plant part, for example);
- (c) introducing a nucleic acid comprising one or more alleles associated with increased fertility (e.g., one or more alleles associated with increased male fertility) into the genome of a maize plant part and producing a maize plant from said maize plant part;
- (d) introducing a nucleic acid comprising one or more alleles associated with increased fertility (e.g., one or more alleles associated with increased male fertility) into the genome of a maize plant or plant part, detecting said allele(s) in said maize plant or plant part (by detecting said allele(s) or an informative fragment thereof in an amplification product from said maize plant or plant part, for example) and producing a maize plant from said maize plant or plant part;
- (e) introducing a nucleic acid comprising one or more alleles associated with increased fertility (e.g., one or more alleles associated with increased male fertility) into the genome of a maize plant or plant part, detecting one or more markers linked to said allele(s) in said maize plant or plant part (by detecting said marker(s) or an informative fragment thereof in an amplification product from said maize plant or plant part, for example) and producing a maize plant from said maize plant or plant part;
- (f) introducing a genomic region comprising one or more transgenes associated with increased fertility (e.g., one or more transgenes associated with increased male fertility) into the genome of a maize plant or plant part and producing a maize plant from said maize plant or plant part;
- (g) introducing a genomic region comprising one or more transgenes associated with increased fertility (e.g., one or more transgenes associated with increased male fertility) into the genome of a maize plant or plant part, detecting said genomic region in said maize plant or plant part (by detecting said transgene(s) or an informative fragment thereof in an amplification product from said maize plant or plant part, for example) and producing a maize plant from said maize plant or plant part; and/or (h) introducing a genomic region comprising one or more transgenes associated with increased fertility (e.g., one or more transgenes associated with increased male fertility) into the genome of a maize plant part or plant part, detecting one or more markers linked to said genomic region in said maize plant part or plant part (by detecting said marker(s) or an informative fragment thereof in an amplification product from said maize plant or plant part, for example) and producing a maize plant from said maize plant or plant part.

Optionally, the method further comprises phenotyping the maize plant or plant part (or an ancestor or progeny plant or part thereof) to confirm the fertility state (e.g., the state of male fertility) or the presence of characteristics associated with fertility.

The invention further contemplates a method of improving seed production from a maize plant, comprising: crossing a first maize plant with a second maize plant, wherein the first maize plant comprises within its genome a marker associated with increased male fertility, and wherein said marker is located within one or more of the chromosomal intervals described in Table 1, to produce a progeny maize plant comprising said marker; and using a progeny maize plant comprising said marker as a pollenator (male) in a cross with itself or a second maize plant that functions as a seed parent (female), thereby improving seed production from the cross as compared with a suitable control cross (e.g., a selfing or cross with the progeny plant lacking the marker associated with increased fertility). In embodiments, the second maize plant lacks the marker. In exemplary embodiments, the method reduces the ratio of pollenator parent to seed parent maize plants required for seed production by at least about 25% as compared with a suitable control cross. In embodiments, the method increases the number of seeds produced per pollenator parent plant and/or seed parent plant by at least about 25%.

Optionally, the method further comprises phenotyping the first maize plant and/or the progeny plant (or an ancestor or progeny plant or part thereof) to confirm the fertility state (e.g., the state of male fertility) or the presence of characteristics associated with fertility.

Markers for use with the methods of the invention can include any one or more suitable markers as described herein.

Markers associated with increased fertility (e.g., male fertility) may be detected using any suitable marker probe as described herein.

In some embodiments, the marker is detected using a probe designed to detect an allele of interest located within one or more of the chromosomal segments described in Table 1. For example, in some embodiments, the marker is detected using a probe designed to detect an allele of interest located within one or more of chromosomal segments 46 to 12473 (e.g., within chromosomal segment 7514).

In some embodiments, the marker is detected using a probe designed to detect two or more alleles located within one or more of the chromosomal segments described in Table 1. For example, in some embodiments, the marker is detected using a probe designed to detect two or more alleles located within one or more of chromosomal segments 46 to 12473 (e.g., a haplotype comprising two or more alleles of interest located within chromosomal segment 7514).

In some embodiments, the marker is detected using a probe designed to detect alleles located in distinct chromosomal segments, wherein each of the distinct chromosomal segments comprises one or more of the chromosomal segments described in Table 1. For example, in some embodiments, the marker is detected using probes designed to detect:

1) one or more alleles of interest located within one or more of chromosomal segments 46 to 12473 (e.g., one or more alleles of interest located within chromosomal segment 7514) and one or more alleles of interest located within chromosomal segment 1;

2) one or more alleles of interest located within one or more of chromosomal segments 46 to 12473 (e.g., one or more alleles of interest located within chromosomal segment 7514) and one or more alleles of interest located on chromosome 2;

3) one or more alleles of interest located within one or more of chromosomal segments 46 to 12473 (e.g., one or more alleles of interest located within chromosomal segment 7514) and one or more alleles of interest located within one or more of chromosomal segments 3 to 17 (e.g., one or more alleles of interest located within chromosomal segment 3);

4) one or more alleles of interest located within one or more of chromosomal segments 46 to 12473 (e.g., one or more alleles of interest located within chromosomal segment 7514) and one or more alleles of interest located within one or more of chromosomal segments 18 to 45 (e.g., one or more alleles of interest located within chromosomal segment 25);

5) one or more alleles of interest located within one or more of chromosomal segments 46 to 12473 (e.g., one or more alleles of interest located within chromosomal segment 7514) and one or more alleles of interest located within one or more of chromosomal segments 12744 to 12749 (e.g., one or more alleles of interest located within chromosomal segment 12747);

6) one or more alleles of interest located within one or more of chromosomal segments 46 to 12473 (e.g., one or more alleles of interest located within chromosomal segment 7514) and one or more alleles of interest located within one or more of chromosomal segments 12750 to 12755 (e.g., one or more alleles of interest located within chromosomal segment 12753);

7) one or more alleles of interest located within one or more of chromosomal segments 46 to 12473 (e.g., one or more alleles of interest located within chromosomal segment 7514) and one or more alleles of interest located within chromosomal segment 12756;

8) one or more alleles of interest located within one or more of chromosomal segments 46 to 12473 (e.g., one or more alleles of interest located within chromosomal segment 7514) and one or more alleles of interest located within one or more of chromosomal segments 12757 to 12762 (e.g., one or more alleles of interest located within chromosomal segment 12760 and/or chromosomal segment 12761);

9) one or more alleles of interest located within one or more of chromosomal segments 46 to 12473 (e.g., one or more alleles of interest located within chromosomal segment 7514) and one or more alleles of interest located within one or more of chromosomal segments 12763 to 12768 (e.g., one or more alleles of interest located within chromosomal segment 12768);

10) one or more alleles of interest located within one or more of chromosomal segments 46 to 12473 (e.g., one or more alleles of interest located within chromosomal segment 7514), one or more alleles of interest located within one or more of chromosomal segments 3 to 17 (e.g., one or more alleles of interest located within chromosomal segment 3), one or more alleles of interest located within one or more of chromosomal segments 18 to 45 (e.g., one or more alleles of interest located within chromosomal segment 25) and one or more alleles of interest located within one or more of chromosomal segments 12763 to 12768 (e.g., one or more alleles of interest located within chromosomal segment 12768);

11) one or more alleles of interest located within one or more of chromosomal segments 3 to 17 (e.g., one or more alleles of interest located within chromosomal segment 3) and one or more alleles of interest located within chromosomal segment 1;

12) one or more alleles of interest located within one or more of chromosomal segments 3 to 17 (e.g., one or more alleles of interest located within chromosomal segment 3) and one or more alleles of interest located on chromosome 2;

13) one or more alleles of interest located within one or more of chromosomal segments 3 to 17 (e.g., one or more alleles of interest located within chromosomal segment 3) and one or more alleles of interest located within one or more of chromosomal segments 18 to 45 (e.g., one or more alleles of interest located within chromosomal segment 25);

14) one or more alleles of interest located within one or more of chromosomal segments 3 to 17 (e.g., one or more alleles of interest located within chromosomal segment 3) and one or more alleles of interest located within one or more of chromosomal segments 12744 to 12749 (e.g., one or more alleles of interest located within chromosomal segment 12747);

15) one or more alleles of interest located within one or more of chromosomal segments 3 to 17 (e.g., one or more alleles of interest located within chromosomal segment 3) and one or more alleles of interest located within one or more of chromosomal segments 12750 to 12755 (e.g., one or more alleles of interest located within chromosomal segment 12753);

16) one or more alleles of interest located within one or more of chromosomal segments 3 to 17 (e.g., one or more alleles of interest located within chromosomal segment 3) and one or more alleles of interest located within chromosomal segment 12756;

17) one or more alleles of interest located within one or more of chromosomal segments 3 to 17 (e.g., one or more alleles of interest located within chromosomal segment 3) and one or more alleles of interest located within one or more of chromosomal segments 12757 to 12762 (e.g., one or more alleles of interest located within chromosomal segment 12760 and/or chromosomal segment 12761);

18) one or more alleles of interest located within one or more of chromosomal segments 3 to 17 (e.g., one or more alleles of interest located within chromosomal segment 3) and one or more alleles of interest located within one or more of chromosomal segments 12763 to 12768 (e.g., one or more alleles of interest located within chromosomal segment 12768);

19) one or more alleles of interest located on chromosome 2, one or more alleles of interest located within one or more of chromosomal segments 3 to 17 (e.g., one or more alleles of interest located within chromosomal segment 3), one or more alleles of interest located within one or more of chromosomal segments 10266 to 10271 (e.g., one or more alleles of interest located within chromosomal segment 10269) and one or more alleles of interest located within chromosomal segment 12756.

In some embodiments, the marker is detected using a probe designed to detect one or more chromosomal segments derived from NP2222 maize germplasm (e.g., NP2222AC maize germplasm), wherein said one or more chromosomal segments comprises, consists essentially of or consists of one or more of the chromosomal segments described in Table 1. For example, in some embodiments, the marker is detected using a probe designed to detect one or more of chromosomal segments 3 to 12768, (e.g., chromosomal segments 3, 13, 25, 506, 7514, 7546, 12747, 12753, 12760-12761 and/or 12767-12768) derived from NP2222 maize germplasm.

In some embodiments, the marker is detected using a probe designed to detect one or more chromosomal segments derived from NP2660 maize germplasm (e.g., NP2660AC NIL-2343, NP2660AC NIL-3338 or NP2660AC NIL-3367 maize germplasm), wherein said one or more chromosomal segments comprises, consists essentially of or consists of one or more of the chromosomal segments described in Table 1. For example, in some embodiments, the marker is detected using a probe designed to detect one or more of chromosomal segments 3 to 12743 and/or one or more of chromosomal segments 12757 to 12768, (e.g., chromosomal segments 3, 13, 25, 506, 7514, 7546, 12747, 12753, 12760-12761 and/or 12767-12768) derived from NP2660 maize germplasm.

In some embodiments, the marker is detected using a probe designed to detect one or more chromosomal segments derived from NP2276 maize germplasm (e.g., NP2276AC NIL maize germplasm), wherein said one or more chromosomal segments comprises, consists essentially of or consists of one or more of the chromosomal segments described in Table 1. For example, in some embodiments, the marker is detected using a probe designed to detect chromosomal segment 1, one or more of chromosomal segments 46 to 12743 and/or one or more of chromosomal segments 12757 to 12768, (e.g., chromosomal segments 13, 506, 7514, 7546 and/or 12760-12761) derived from NP2276 maize germplasm.

In some embodiments, the marker is detected using a probe designed to detect one or more chromosomal segments derived from ID3461 maize germplasm, wherein said one or more chromosomal segments comprises, consists essentially of or consists of one or more of the chromosomal segments described in Table 1. For example, in some embodiments, the marker is detected using a probe designed to detect one or more of chromosomal segments 1 to 17 (e.g., chromosomal segments 1 and/or 13) derived from 191D3461 maize germplasm.

In embodiments, the marker is detected using a probe designed to detect one or more chromosomal segments derived from a line in Table 11.

In some embodiments, the marker is detected using a probe designed to detect at least one of SEQ ID NOs: 1 to 350 (as described in Table 3).

In some embodiments, the marker is detected using a probe designed to detect any nucleotide sequence that is at least about 75%, 80%, 85%, 90%, 95%, 96%, 97%, 98%, 99%, 99.5% or more identical to one or more of SEQ ID NOs: 1 to 350 (as described in Table 3).

In some embodiments, the marker is detected using a probe designed to detect any nucleotide sequence that specifically hybridizes to the nucleotide sequence of one or more of SEQ ID NOs: 1 to 350 (as described in Table 3) under stringent hybridization conditions. In some embodiments, the marker is detected using a probe designed to detect any nucleotide sequence that encodes the amino acid sequence set forth in one or more of SEQ ID NOs: 351 to 525 (as described in Table 3).

In some embodiments the marker is detected using a probe designed to detect any nucleotide sequence that encodes an amino acid sequence that is at least about 75%, 80%, 85%, 90%, 95%, 96%, 97%, 98%, 99%, 99.5% or more identical to the amino acid sequence set forth in one or more of SEQ ID NOs: 351 to 525 (as described in Table 3).

In some embodiments, the marker is detected using a probe designed to detect at least one of SEQ ID NOs: 526 to 613 (as described in Table 9).

In some embodiments, the marker is detected using a probe designed to detect any nucleotide sequence that is at least about 75%, 80%, 85%, 90%, 95%, 96%, 97%, 98%, 99%, 99.5% or more identical to one or more of SEQ ID NOs: 526 to 613 (as described in Table 9).

In some embodiments, the marker is detected using a probe designed to detect any nucleotide sequence that specifically hybridizes to the nucleotide sequence of one or more of SEQ ID NOs: 526 to 613 (as described in Table 9) under stringent hybridization conditions.

In some embodiments, the marker is detected using a probe designed to detect one or more of the desired alleles described in Table 2. For example, in some embodiments, the marker is detected using a probe designed to detect 2, 3, 4, 5, 6, 7, 8, 9, 10, 11, 12, 13, 14, 15, 20, 25, 30, 35, 40, 45, 50, 55, 60, 65, 70, 75, 80, 85, 90, 95, 100, 110, 120, 130, 140 or more of the desired alleles described in Table 2.

In embodiments, the marker is detected using a probe designed to detect one or more of the desired alleles described in Table 8. For example, in some embodiments, the marker is detected using a probe designed to detect at least about 2, 3, 4, 5, 6, 7, 8, 9, 10, 11, 12, 13, 14, 15, 16, 17 or more, or all 18 of the desired alleles described in Table 8 (see, e.g., the exemplary probes described in Table 9).

In embodiments, the marker is detected using a probe designed to detect one or more of the desired alleles:
(a) on chromosome 5 (QTL 5.1 and/or QTL 5.2) as described in Table 8;
(b) on chromosome 3 as described in Table 8;
(c) on chromosome 7 as described in Table 8;
(d) on chromosome 10 as described in Table 8;
(e) on chromosomes 3 and 5 as described in Table 8;
(f) on chromosomes 5 and 7 as described in Table 8;
(g) on chromosomes 3, 5 and 7 as described in Table 8;
(h) on chromosomes 5 and 10 as described in Table 8;
(i) on chromosomes 3, 5 and 10 as described in Table 8;
or
(j) any combination of (a) to (i).

In some embodiments, the marker is detected using a probe designed to detect one or more of the desired alleles described in Table 10. For example, in some embodiments, the marker is detected using a probe designed to detect 2, 3, 4, 5, 6, 7, 8, 9, 10, 11, 12, 13, 14, 15, 20, 25 or more of the desired alleles described in Table 10.

In some embodiments, the marker is detected using a probe designed to detect the reverse complement of one of a marker as described herein.

In some embodiments, the marker is detected using a probe designed to detect an informative fragment of one of the markers as described herein.

In some embodiments, the marker is detected using a probe designed to detect a marker linked to one or more of the markers described herein. That is, the marker may be detected using a probe designed to detect a marker that is in linkage disequilibrium with any of the markers described herein.

In some embodiments, the marker is detected using a probe designed to detect a marker located within about 20 cM, 15 cM, 10 cM, 5 cM or 1 cM or less of any one of the markers described herein. For example, in some embodiments, the marker is detected using a probe designed to detect one or more markers located within about 5 cM, 1 cM or less of chromosomal segment 7514.

Markers associated with increased fertility may be detected in any suitable plant part, including, but not limited to, amplification products derived from maize germplasm.

Markers associated with increased fertility may be detected in any suitable amplification product, for example, an amplification product as described herein.

In some embodiments, the marker is detected in an amplification product comprising, consisting essentially of, or consisting of one or more of the chromosomal segments described in Table 1. For example, in some embodiments, the marker may be detected in an amplification product comprising, consisting essentially of, or consisting of:
(a) chromosomal segment 1;
(b) one or more of chromosomal segments 3 to 17 (e.g., within chromosomal segment 3);
(c) one or more of chromosomal segments 18 to 45 (e.g., within chromosomal segment 25);
(d) one or more of chromosomal segments 46 to 12473 (e.g., within chromosomal segment 7514);
(e) one or more of chromosomal segments 12744 to 12749 (e.g., within chromosomal segment 12747);
(f) one or more of chromosomal segments 12750 to 12755 (e.g., within chromosomal segment 12753);
(g) one or more of chromosomal segment 12756;
(h) one or more of chromosomal segments 12757 to 12762 (e.g., within chromosomal segment 12760 and/or chromosomal segment 12761); or
(i) one or more of chromosomal segments 12763 to 12768 (e.g., within chromosomal segment 12768).

In some embodiments, the marker is detected in an amplification product comprising, consisting essentially of, or consisting of at least one of SEQ ID NOs: 1 to 350 (as described in Table 3).

In some embodiments, the marker is detected in an amplification product comprising, consisting essentially of, or consisting of a nucleotide sequence that is at least about 75%, 80%, 85%, 90%, 95%, 96%, 97%, 98%, 99%, 99.5% or more identical to one or more of SEQ ID NOs: 1 to 350 (as described in Table 3).

In some embodiments, the marker is detected in an amplification product comprising, consisting essentially of, or consisting of a nucleotide sequence that specifically hybridizes to the nucleotide sequence of one or more of SEQ ID NOs: 1 to 350 (as described in Table 3) under stringent hybridization conditions.

In some embodiments, the marker is detected in an amplification product comprising, consisting essentially of, or consisting of a nucleotide sequence that encodes the amino acid sequence set forth in one or more of SEQ ID NOs: 351 to 525 (as described in Table 3).

In some embodiments, the marker is detected in an amplification product comprising, consisting essentially of, or consisting of a nucleotide sequence that encodes an amino acid sequence that is at least about 75%, 80%, 85%, 90%, 95%, 96%, 97%, 98%, 99%, 99.5% or more identical to the amino acid sequence set forth in one or more of SEQ ID NOs: 351 to 525 (as described in Table 3).

In some embodiments, the marker is detected using a probe designed to detect at least one of SEQ ID NOs: 526 to 613 (as described in Table 9).

In some embodiments, the marker is detected in an amplification product comprising, consisting essentially of, or consisting of a nucleotide sequence that is at least about 75%, 80%, 85%, 90%, 95%, 96%, 97%, 98%, 99%, 99.5% or more identical to one or more of SEQ ID NOs: 526 to 613 (as described in Table 9).

In some embodiments, the marker is detected in an amplification product comprising, consisting essentially of, or consisting of a nucleotide sequence that specifically hybridizes to the nucleotide sequence of one or more of SEQ ID NOs: 526 to 613 (as described in Table 9) under stringent hybridization conditions.

In some embodiments, the marker is detected in an amplification product comprising one or more of the desired alleles described in Table 2. For example, in some embodiments, the marker is detected in an amplification product comprising 2, 3, 4, 5, 6, 7, 8, 9, 10, 11, 12, 13, 14, 15, 20, 25, 30, 35, 40, 45, 50, 55, 60, 65, 70, 75, 80, 85, 90, 95, 100, 110, 120, 130, 140 or more of the desired alleles described in Table 2.

In embodiments, the marker is detected in an amplification product comprising one or more of the desired alleles described in Table 8. For example, in some embodiments, the marker is detected in an amplification product comprising at least about 2, 3, 4, 5, 6, 7, 8, 9, 10, 11, 12, 13, 14, 15, 16, 17 or more, or all 18 of the desired alleles described in Table 8 (see, e.g., the exemplary amplification primers and probes described in Table 9).

In embodiments, the marker is detected in an amplification product comprising one or more of the desired alleles:
(a) on chromosome 5 (QTL 5.1 and/or QTL 5.2) as described in Table 8;
(b) on chromosome 3 as described in Table 8;
(c) on chromosome 7 as described in Table 8;
(d) on chromosome 10 as described in Table 8;
(e) on chromosomes 3 and 5 as described in Table 8;
(f) on chromosomes 5 and 7 as described in Table 8;
(g) on chromosomes 3, 5 and 7 as described in Table 8;
(h) on chromosomes 5 and 10 as described in Table 8;
(i) on chromosomes 3, 5 and 10 as described in Table 8; or
(j) any combination of (a) to (i).

In some embodiments, the marker is detected in an amplification product comprising one or more of the desired alleles described in Table 10. For example, in some embodiments, the marker is detected in an amplification product comprising 2, 3, 4, 5, 6, 7, 8, 9, 10, 11, 12, 13, 14, 15, 20, 25 or more of the desired alleles described in Table 10.

Alleles may be introduced into maize plants and plant parts using any suitable method, including, but not limited to, crossing, transfection, transduction, protoplast transformation or fusion, double haploid technique, embryo rescue, or by any other nucleic acid transfer system. In some embodiments, one or more alleles associated with increased fertility is/are introduced into the genome of a maize plant or plant part through a breeding program comprising MAS using one or more of the markers described herein.

Thus, in some embodiments, methods of producing maize plants and plant parts having increased fertility (e.g., increased male fertility) or one or more characteristics associated with increased fertility and/or maize plants and plant parts comprising one or more alleles associated with increased fertility and methods of improving pollen production may comprise:

(a) crossing a first maize plant or plant part with a second maize plant or plant part, wherein the first maize plant or plant part comprises within its genome one or more alleles associated with increased fertility (e.g., one or more alleles associated with increased male fertility);

(b) crossing a first maize plant or plant part with a second maize plant or plant part, wherein the first maize plant or plant part comprises within its genome one or more haplotypes associated with increased fertility (e.g., one or more alleles associated with increased male fertility);

(c) detecting the presence of one or more alleles associated with increased fertility (e.g., one or more alleles associated with increased male fertility) in a first maize plant or plant part (by detecting said allele(s) or an informative fragment thereof in an amplification product from said maize plant or plant part, for example) and crossing the first maize plant or plant part with a second maize plant or plant part lacking said allele(s);

(d) detecting the presence of one or more haplotypes associated with increased fertility (e.g., one or more haplotypes associated with increased male fertility) in a first maize plant or plant part (by detecting said haplotype(s) or an informative fragment thereof in an amplification product from said maize plant or plant part, for example) and crossing the first maize plant or plant part with a second maize plant or plant part lacking said allele(s);

(e) detecting the presence of one or more transgenes associated with increased fertility (e.g., one or more transgenes associated with increased male fertility) in a first maize plant or plant part (by detecting said transgene(s) or an informative fragment thereof in an amplification product from said maize plant or plant part, for example) and crossing the first maize plant or plant part with a second maize plant or plant part lacking said marker(s);

(f) detecting the presence of a genomic region comprising one or more transgenes associated with increased fertility (e.g., one or more transgenes associated with increased male fertility) in a first maize plant or plant part (by detecting said genomic region or an informative fragment thereof in an amplification product from said maize plant or plant part, for example) and crossing the first maize plant or plant part with a second maize plant or plant part lacking said genomic region;

(g) detecting the presence of one or more markers associated with increased fertility (e.g., one or more markers associated with increased male fertility) in a first maize plant or plant part (by detecting said marker(s) or an informative fragment thereof in an amplification product from said maize plant or plant part, for example) and crossing the first maize plant or plant part with a second maize plant or plant part lacking said marker(s);

(h) crossing a first maize plant or plant part comprising one or more alleles associated with increased fertility (e.g., one or more alleles associated with increased male fertility) with a second maize plant or plant part that lacks said allele(s) and backcrossing for one or more generations progeny comprising said allele(s) with said second maize plant or plant part;

(i) detecting the presence of one or more alleles associated with increased fertility (e.g., one or more alleles associated with increased male fertility) in a first maize plant or plant part (by detecting said allele(s) or an informative fragment thereof in an amplification product from said maize plant or plant part, for example), crossing the first maize plant or plant part with a second maize plant or plant part lacking said allele(s), and backcrossing for one or more generations progeny comprising said allele(s) with said second maize plant or plant part;

(j) detecting the presence of one or more haplotypes associated with increased fertility (e.g., one or more haplotypes associated with increased male fertility) in a first maize plant or plant part (by detecting said haplotype(s) or an informative fragment thereof in an amplification product from said maize plant or plant part, for example), crossing the first maize plant or plant part with a second maize plant or plant part lacking said haplotype(s), and backcrossing for one or more generations progeny comprising said haplotype(s) with said second maize plant or plant part;

(k) detecting the presence of one or more transgenes associated with increased fertility (e.g., one or more transgenes associated with increased male fertility) in a first maize plant or plant part (by detecting said transgene(s) or an informative fragment thereof in an amplification product from said maize plant or plant part, for example), crossing the first maize plant or plant part with a second maize plant or plant part lacking said transgene(s), and backcrossing for one or more generations progeny comprising said transgene(s) with said second maize plant or plant part; and/or (l) detecting the presence of a genomic region comprising one or more transgenes associated with increased fertility (e.g., one or more transgenes associated with increased male fertility) in a first maize plant or plant part (by detecting said genomic region or an informative fragment thereof in an amplification product from said maize plant or plant part, for example), crossing the first maize plant or plant part with a second maize plant or plant part lacking said genomic region, and backcrossing for one or more generations progeny comprising said genomic region with said second maize plant or plant part; and/or (m) detecting the presence of one or more markers associated with increased fertility (e.g., one or more markers associated with increased male fertility) in a first maize plant or plant part (by detecting said marker(s) or an informative fragment thereof in an amplification product from said maize plant or plant part, for example), crossing the first maize plant or plant part with a second maize plant or plant part lacking said marker(s), and backcrossing for one or more generations progeny comprising said marker(s) with said second maize plant or plant part.

Optionally, the method further comprises phenotyping the maize plant or plant part (or an ancestor or progeny plant or part thereof) to confirm the fertility state (e.g., the state of male fertility) or the presence of characteristics associated with fertility.

Any suitable allele(s) may be introduced into the maize plant or plant part, including, but not limited to, any one or more of the alleles described.

In some embodiments, a nucleic acid comprising, consisting essentially of, or consisting of one or more of the chromosomal segments described in Table 1 is introduced into the maize plant or plant part. For example, in some embodiments, one or more of chromosomal segments 46 to 12473 (e.g., chromosomal segment 7514) is introduced into the maize plant or plant part.

In some embodiments, one or more haplotypes associated with increased fertility (e.g., increased male fertility) is introduced into the maize plant or plant part. The haplotype can include any of one or more of the haplotypes as described herein. In some such embodiments, the haplotype comprises, consists essentially of or consists of two or more alleles of interest located within one or more of the chromosomal segments described in Table 1 (e.g., a haplotype comprising two or more alleles of interest located within chromosomal segment 7514). In some such embodiments, the haplotype comprises, consists essentially of or consists of one or more alleles of interest located within a first chromosomal segment and one or more alleles of interest located within a second chromosomal segment different from the first chromosomal segment, wherein each of the first and second chromosomal segments comprises one or more of the chromosomal segments described in Table 1. For example, the haplotype may comprise, consist essentially of or consist of:

1) one or more alleles of interest located within one or more of chromosomal segments 46 to 12473 (e.g., one or more alleles of interest located within chromosomal segment 7514) and one or more alleles of interest located within chromosomal segment 1;

2) one or more alleles of interest located within one or more of chromosomal segments 46 to 12473 (e.g., one or more alleles of interest located within chromosomal segment 7514) and one or more alleles of interest located on chromosome 2;

3) one or more alleles of interest located within one or more of chromosomal segments 46 to 12473 (e.g., one or more alleles of interest located within chromosomal segment 7514) and one or more alleles of interest located within one or more of chromosomal segments 3 to 17 (e.g., one or more alleles of interest located within chromosomal segment 3);

4) one or more alleles of interest located within one or more of chromosomal segments 46 to 12473 (e.g., one or more alleles of interest located within chromosomal segment 7514) and one or more alleles of interest located within one or more of chromosomal segments 18 to 45 (e.g., one or more alleles of interest located within chromosomal segment 25);

5) one or more alleles of interest located within one or more of chromosomal segments 46 to 12473 (e.g., one or more alleles of interest located within chromosomal segment 7514) and one or more alleles of interest located within one or more of chromosomal segments 12744 to 12749 (e.g., one or more alleles of interest located within chromosomal segment 12747);

6) one or more alleles of interest located within one or more of chromosomal segments 46 to 12473 (e.g., one or more alleles of interest located within chromosomal segment 7514) and one or more alleles of interest located within one or more of chromosomal segments 12750 to 12755 (e.g., one or more alleles of interest located within chromosomal segment 12753);

7) one or more alleles of interest located within one or more of chromosomal segments 46 to 12473 (e.g., one or more alleles of interest located within chromosomal segment 7514) and one or more alleles of interest located within chromosomal segment 12756;

8) one or more alleles of interest located within one or more of chromosomal segments 46 to 12473 (e.g., one or more alleles of interest located within chromosomal segment 7514) and one or more alleles of interest located within one or more of chromosomal segments 12757 to 12762 (e.g., one or more alleles of interest located within chromosomal segment 12760 and/or chromosomal segment 12761);

9) one or more alleles of interest located within one or more of chromosomal segments 46 to 12473 (e.g., one or more alleles of interest located within chromosomal segment 7514) and one or more alleles of interest located within one or more of chromosomal segments 12763 to 12768 (e.g., one or more alleles of interest located within chromosomal segment 12768);

10) one or more alleles of interest located within one or more of chromosomal segments 46 to 12473 (e.g., one or more alleles of interest located within chromosomal segment 7514), one or more alleles of interest located within one or more of chromosomal segments 3 to 17 (e.g., one or more alleles of interest located within chromosomal segment 3), one or more alleles of interest located within one or more of chromosomal segments 18 to 45 (e.g., one or more alleles of interest located within chromosomal segment 25) and one or more alleles of interest located within one or more of chromosomal segments 12763 to 12768 (e.g., one or more alleles of interest located within chromosomal segment 12768);

11) one or more alleles of interest located within one or more of chromosomal segments 3 to 17 (e.g., one or more alleles of interest located within chromosomal segment 3) and one or more alleles of interest located within chromosomal segment 1;

12) one or more alleles of interest located within one or more of chromosomal segments 3 to 17 (e.g., one or more alleles of interest located within chromosomal segment 3) and one or more alleles of interest located on chromosome 2;

13) one or more alleles of interest located within one or more of chromosomal segments 3 to 17 (e.g., one or more alleles of interest located within chromosomal segment 3) and one or more alleles of interest located within one or more of chromosomal segments 18 to 45 (e.g., one or more alleles of interest located within chromosomal segment 25);

14) one or more alleles of interest located within one or more of chromosomal segments 3 to 17 (e.g., one or more alleles of interest located within chromosomal segment 3) and one or more alleles of interest located within one or more of chromosomal segments 12744 to 12749 (e.g., one or more alleles of interest located within chromosomal segment 12747);

15) one or more alleles of interest located within one or more of chromosomal segments 3 to 17 (e.g., one or more alleles of interest located within chromosomal segment 3) and one or more alleles of interest located within one or more of chromosomal segments 12750 to 12755 (e.g., one or more alleles of interest located within chromosomal segment 12753);

16) one or more alleles of interest located within one or more of chromosomal segments 3 to 17 (e.g., one or more alleles of interest located within chromosomal segment 3) and one or more alleles of interest located within chromosomal segment 12756);

17) one or more alleles of interest located within one or more of chromosomal segments 3 to 17 (e.g., one or more alleles of interest located within chromosomal segment 3) and one or more alleles of interest located within one or more of chromosomal segments 12757 to 12762 (e.g., one or more alleles of interest located within chromosomal segment 12760 and/or chromosomal segment 12761);

18) one or more alleles of interest located within one or more of chromosomal segments 3 to 17 (e.g., one or more alleles of interest located within chromosomal segment 3) and one or more alleles of interest located within one or more of chromosomal segments 12763 to 12768 (e.g., one or more alleles of interest located within chromosomal segment 12768);

19) one or more alleles of interest located on chromosome 2, one or more alleles of interest located within one or more of chromosomal segments 3 to 17 (e.g., one or more alleles of interest located within chromosomal segment 3), one or more alleles of interest located within one or more of chromosomal segments 10266 to 10271 (e.g., one or more alleles of interest located within chromosomal segment 10269) and one or more alleles of interest located within chromosomal segment 12756.

In some embodiments, a nucleic acid comprising, consisting essentially of, or consisting of one or more chromosomal segments derived from NP2222 maize germplasm is introduced into the maize plant or plant part, wherein said one or more chromosomal segments comprises, consists essentially of or consists of one or more of the chromosomal segments described in Table 1. For example, in some embodiments, one or more of chromosomal segments 3 to 12768, (e.g., chromosomal segments 3, 13, 25, 506, 7514, 7546, 12747, 12753, 12760-12761 and/or 12767-12768) derived from NP2222 maize germplasm is introduced into the maize plant or plant part.

In some embodiments, a nucleic acid comprising, consisting essentially of, or consisting of one or more chromosomal segments derived from NP2660 maize germplasm is introduced into the maize plant or plant part, wherein said one or more chromosomal segments comprises, consists essentially of or consists of one or more of the chromosomal segments described in Table 1. For example, in some embodiments, one or more of chromosomal segments 3 to 12743 and/or one or more of chromosomal segments 12757 to 12768, (e.g., chromosomal segments 3, 13, 25, 506, 7514, 7546, 12747, 12753, 12760-12761 and/or 12767-12768) derived from NP2660 maize germplasm is introduced into the maize plant or plant part.

In some embodiments, a nucleic acid comprising, consisting essentially of, or consisting of one or more chromosomal segments derived from NP2276 maize germplasm is introduced into the maize plant or plant part, wherein said one or more chromosomal segments comprises, consists essentially of or consists of one or more of the chromosomal segments described in Table 1. For example, in some embodiments, chromosomal segment 1, one or more of chromosomal segments 46 to 12743 and/or one or more of chromosomal segments 12757 to 12768, (e.g., chromosomal segments 13, 506, 7514, 7546 and/or 12760-12761) derived from NP2276 maize germplasm is introduced into the maize plant or plant part.

In some embodiments, a nucleic acid comprising, consisting essentially of, or consisting of one or more chromosomal segments derived from ID3461 maize germplasm is introduced into the maize plant or plant part, wherein said one or more chromosomal segments comprises, consists essentially of or consists of one or more of the chromosomal segments described in Table 1. For example, in some embodiments, one or more of chromosomal segments 1 to 17 (e.g., chromosomal segments 1 and/or 13) derived from ID3461 maize germplasm is introduced into the maize plant or plant part.

In some embodiments, a nucleic acid comprising, consisting essentially of, or consisting of one or more chromosomal segments derived from a maize line in Table 11 is introduced into the maize plant or plant part, wherein said one or more chromosomal segments comprises, consists essentially of or consists of one or more of the chromosomal segments described in Table 1.

In some embodiments, one or more genes associated with increased fertility (e.g., increased male fertility) is introduced into the maize plant or plant part.

In some embodiments, a nucleic acid comprising, consisting essentially of, or consisting of at least one of the nucleotide sequences of SEQ ID NOs: 1 to 350 (as described in Table 3) is introduced into the maize plant or plant part.

In some embodiments, a nucleic acid comprising, consisting essentially of, or consisting of at least one nucleotide sequence that is at least about 75%, 80%, 85%, 90%, 95%, 96%, 97%, 98%, 99%, 99.5% or more identical to one or more of SEQ ID NOs: 1 to 350 (as described in Table 3) is introduced into the maize plant or plant part.

In some embodiments, a nucleic acid comprising, consisting essentially of, or consisting of at least one nucleotide sequence that specifically hybridizes to the nucleotide sequence of one or more of SEQ ID NOs: 1 to 350 (as described in Table 3) under stringent hybridization conditions is introduced into the maize plant or plant part.

In some embodiments, a nucleic acid comprising, consisting essentially of, or consisting of at least one nucleotide sequence that encodes the amino acid sequence set forth in one or more of SEQ ID NOs: 351 to 525 (as described in Table 3) is introduced into the maize plant or plant part.

In some embodiments, a nucleic acid comprising, consisting essentially of, or consisting of at least one nucleotide sequence that encodes an amino acid sequence that is at least about 75%, 80%, 85%, 90%, 95%, 96%, 97%, 98%, 99%, 99.5% or more identical to the amino acid sequence set forth in one or more of SEQ ID NOs: 351 to 525 (as described in Table 3) is introduced into the maize plant or plant part.

In some embodiments, a nucleic acid comprising, consisting essentially of, or consisting of one or more of the desired alleles described in Table 2 is introduced into the maize plant or plant part.

In embodiments, a nucleic acid comprising, consisting essentially of, or consisting of one or more of the desired alleles described in Table 8 is introduced into the maize plant or plant part.

In embodiments, a nucleic acid is introduced into a maize plant or plant part, the nucleic acid comprising, consisting essentially of, or consisting of one or more of the desired alleles:
(a) on chromosome 5 (QTL 5.1 and/or QTL 5.2) as described in Table 8;
(b) on chromosome 3 as described in Table 8;
(c) on chromosome 7 as described in Table 8;
(d) on chromosome 10 as described in Table 8;
(e) on chromosomes 3 and 5 as described in Table 8;
(f) on chromosomes 5 and 7 as described in Table 8;
(g) on chromosomes 3, 5 and 7 as described in Table 8;
(h) on chromosomes 5 and 10 as described in Table 8;
(i) on chromosomes 3, 5 and 10 as described in Table 8; or
(j) any combination of (a) to (i).

In some embodiments, a nucleic acid comprising one or more of the desired alleles described in Table 10 is introduced into the maize plant or plant part.

In some embodiments, a nucleic acid comprising, consisting essentially of, or consisting of the reverse complement of one of the nucleic acids described herein is introduced into the maize plant or plant part.

In some embodiments, the nucleic acid introduced into the maize plant or plant part is not in the natural genetic background of the maize plant (e.g., is not naturally occurring in the maize line or variety, and has been introduced therein by human intervention).

In the methods of the invention described herein, the marker, allele and/or haplotype, and the like, is detected in nucleic acid (e.g., a nucleic acid sample) from plant or plant part.

In embodiments, the marker, allele and/or haplotype, and the like, is detected in an amplification product from a nucleic acid sample from the plant or plant part.

The methods of the invention can be used for forward breeding or for introgressing one or more genetic loci associated with increased fertility into a new genetic background (e.g., to introgress the trait into an elite inbred maize line).

Methods of the present invention may be used to increase the efficiency of a breeding and/or seed production program (e.g., seed production from a double haploid or inbred line) by reducing the number of male plants required for breeding and/or seed production, reducing the ratio of male to female plants required for breeding and/or seed production, reducing the costs associated with breeding and/or seed production (e.g., the cost(s) of land and seedbed preparation, planting, fertilizer application, weed control, harvesting and/or testing), increasing pollen production (e.g., pollen production per anther/tassel/plant), improving pollen morphology, increasing pollen viability, increasing anther production (e.g., anther production per tassel/plant), improving anther morphology, increasing anther viability, increasing tassel production (e.g., tassel production per plant), improving tassel morphology, increasing tassel viability, increasing silk production (e.g., silk production per ear/plant), improving silk morphology, increasing silk viability, increasing seed production (e.g., seed production per ear/plant), improving seed morphology, decreasing the prevalence of kernel abortion, increasing seed viability, increasing male fertility under stress conditions (e.g., drought conditions), increasing fertility (e.g., male fertility) under elevated daytime temperatures and/or increasing fertility (e.g., male fertility) under elevated nighttime temperatures.

In some embodiments, methods of the present invention increase the efficiency of a breeding and/or seed production program by at least about 5%, 10%, 15%, 20%, 25%, 30%, 35%, 40%, 45%, 50%, 55%, 60%, 65%, 70%, 75% 80%, 85%, 90%, 95%, 100%, 110%, 120%, 130%, 140%, 150%, 160%, 170%, 180%, 190%, 200%, 225%, 250%, 275% 300% or more as compared to a control breeding/seed production program (e.g., a breeding/seed production program using the same maize varieties in the absence of marker-assisted selection with markers of the present invention).

In some embodiments, methods of the present invention reduce the number of male plants required for a breeding and/or seed production program by at least about 5%, 10%, 15%, 20%, 25%, 30%, 35%, 40%, 45%, 50%, 55%, 60%, 65%, 70%, 75% 80%, 85%, 90%, 95%, 96%, 97%, 98%, 99% or more as compared to a control breeding program (e.g., a breeding program using the same maize varieties in the absence of marker-assisted selection with markers of the present invention).

In some embodiments, methods of the present invention reduce the ratio of male to female plants required for a breeding and/or seed production program by at least about 5%, 10%, 15%, 20%, 25%, 30%, 35%, 40%, 45%, 50%, 55%, 60%, 65%, 70%, 75% 80%, 85%, 90%, 95%, 96%, 97%, 98%, 99% or more as compared to a control breeding program (e.g., a breeding program using the same maize varieties in the absence of marker-assisted selection with markers of the present invention).

In some embodiments, methods of the present invention reduce one or more of the costs associated with a breeding and/or seed production program (e.g., the cost(s) of land and seedbed preparation, planting, fertilizer application, weed control, harvesting and/or testing) by at least about 5%, 10%, 15%, 20%, 25%, 30%, 35%, 40%, 45%, 50%, 55%, 60%, 65%, 70%, 75% 80%, 85%, 90%, 95%, 96%, 97%, 98%, 99% or more as compared to a control breeding/seed production program (e.g., a breeding/seed production program using the same maize varieties in the absence of marker-assisted selection with markers of the present invention). In embodiments, the seed production program produces seed from a double haploid or inbred line).

In some embodiments, methods of the present invention reduce the overall cost associated of a breeding and/or seed production program by at least about 5%, 10%, 15%, 20%, 25%, 30%, 35%, 40%, 45%, 50%, 55%, 60%, 65%, 70%, 75% 80%, 85%, 90%, 95%, 96%, 97%, 98%, 99% or more as compared to a control breeding/seed production program (e.g., a breeding/seed production program using the came maize varieties in the absence of marker-assisted selection with markers of the present invention). In embodiments, the seed production program produces seed from a double haploid or inbred line).

In some embodiments, methods of the present invention increase the number of pollen grains produced per plant in a breeding and/or seed production program by at least about 5%, 10%, 15%, 20%, 25%, 30%, 35%, 40%, 45%, 50%, 55%, 60%, 65%, 70%, 75% 80%, 85%, 90%, 95%, 100%, 110%, 120%, 130%, 140%, 150%, 160%, 170%, 180%, 190%, 200%, 225%, 250%, 275%, 300% or more as compared to a control breeding/seed production program (e.g., a breeding/seed production program using the same maize varieties in the absence of marker-assisted selection with markers of the present invention).

In some embodiments, methods of the present invention increase the number of withers produced per plant in a breeding and/or seed production program by at least about 5%, 10%, 15%, 20%, 25%, 30%, 35%, 40%, 45%, 50%, 55%, 60%, 65%, 70%, 75% 80%, 85%, 90%, 95%, 100%, 110%, 120%, 130%, 140%, 150%, 160%, 170%, 180%, 190%, 200%, 225%, 250%, 275%, 300% or more as compared to a control breeding/seed production program (e.g., a breeding/seed production program using the same maize varieties in the absence of marker-assisted selection with markers of the present invention).

In some embodiments, methods of the present invention increase the number of tassels produced per plant in a breeding and/or seed production program by at least about 5%, 10%, 15%, 20%, 25%, 30%, 35%, 40%, 45%, 50%, 55%, 60%, 65%, 70%, 75% 80%, 85%, 90%, 95%, 100%, 110%, 120%, 130%, 140%, 150%, 160%, 170%, 180%, 190%, 200%, 225%, 250%, 275%, 300% or more as compared to a control breeding/seed production program (e.g., a breeding/seed production program using the same maize varieties in the absence of marker-assisted selection with markers of the present invention).

In some embodiments, methods of the present invention increase the number of seeds produced per plant in a breeding and/or seed production program by at least about 5%, 10%, 15%, 20%, 25%, 30%, 35%, 40%, 45%, 50%, 55%, 60%, 65%, 70%, 75% 80%, 85%, 90%, 95%, 100%, 110%, 120%, 130%, 140%, 150%, 160%, 170%, 180%, 190%, 200%, 225%, 250%, 275%, 300% or more as compared to a control breeding/seed production program (e.g., a breeding/seed production program using the same maize varieties in the absence of marker-assisted selection with markers of the present invention).

In some embodiments, methods of the present invention increase the number of seeds produced per male plant in a breeding and/or seed production program by at least about 5%, 10%, 15%, 20%, 25%, 30%, 35%, 40%, 45%, 50%, 55%, 60%, 65%, 70%, 75% 80%, 85%, 90%, 95%, 100%, 110%, 120%, 130%, 140%, 150%, 160%, 170%, 180%, 190%, 200%, 225%, 250%, 275%, 300% or more as compared to a control breeding/seed production program (e.g., a breeding/seed production program using the same maize varieties in the absence of marker-assisted selection with markers of the present invention).

In some embodiments, methods of the present invention increase the number of seeds produced per female plant in a breeding and/or seed production program by at least about 5%, 10%, 15%, 20%, 25%, 30%, 35%, 40%, 45%, 50%, 55%, 60%, 65%, 70%, 75% 80%, 85%, 90%, 95%, 100%, 110%, 120%, 130%, 140%, 150%, 160%, 170%, 180%, 190%, 200%, 225%, 250%, 275%, 300% or more as compared to a control breeding/seed production program (e.g., a breeding/seed production program using the same maize varieties in the absence of marker-assisted selection with markers of the present invention).

Methods of the present invention can be practiced with and/or used to identify, breed, select and/or produce any suitable maize plant or plant part.

In some embodiments, the maize plant or plant part (e.g., the donor and/or the recipient plant or plant part) is a member of the Stiff Stalk heterotic group.

In some embodiments, the maize plant or plant part (e.g., the donor and/or the recipient plant or plant part) is a member of the non-Stiff Stalk heterotic group.

In some embodiments, the maize plant or plant part (e.g., the donor and/or the recipient plant or plant part) is a member of the Iodent heterotic group.

In some embodiments, the maize plant or plant part (e.g., the donor and/or the recipient plant or plant part) is a B14, B37, B73, OH43 or Iodent maize plant or plant part. In embodiments, the donor plant or plant part is from the B14 group. In embodiments, the recipient plant or plant part is from the B37 or B73 group.

In some embodiments, the maize plant or plant part (e.g., the donor and/or the recipient plant or plant part) is an NP2391, NP2460, NP2222, NP2660, NP2276 or ID3461 maize plant or plant part.

In some embodiments, the maize plant or plant part (e.g., the donor and/or the recipient plant or plant part) is from a line described in Table 11.

In some embodiments, the maize plant or plant part (e.g., the donor and/or the recipient plant or plant part) is derived from a B14, B37, B73, OH43 or Iodent maize plant or plant part.

In some embodiments, the maize plant or plant part (e.g., the donor and/or the recipient plant or plant part) is derived from an NP2391, NP2460, NP2222, NP2660, NP2276 or ID3461 maize plant or plant part.

In some embodiments, the maize plant or plant part (e.g., the donor and/or the recipient plant or plant part) is derived from a line in Table 11.

In some embodiments, the maize plant or plant part (e.g., the donor and/or the recipient plant or plant part) is of a nonnaturally occurring maize line or variety. In representative embodiments, the nonnaturally occurring plant or plant part (e.g., the donor and/or the recipient plant or plant part) is from a cultivated plant or plant part.

In some embodiments, the maize plant or plant part (e.g., the donor and/or the recipient plant or plant part) is an inbred maize plant or plant part.

In some embodiments, the maize plant or plant part (e.g., the donor and/or the recipient plant or plant part) is a double haploid maize plant or plant part.

In some embodiments, an inbred or double haploid or inbred maize plant or plant part (e.g., the donor and/or the recipient plant or plant part) is a male inbred or double haploid plant or plant part (e.g., is used as a pollenator in a cross or to self).

In some embodiments, the maize plant or plant part (e.g., the donor and/or the recipient plant or plant part) is of an elite variety of maize. For example, in some embodiments, the maize plant or plant part is NP2222, NP2660, NP2276, NP2391 or NP2460.

In embodiments, the maize plant or plant part (e.g., the recipient plant or plant part) has a decrease in male fertility when hemizygous and/or homozygous for a vip3 gene (for example, a vip3a gene, as illustrated by maize event MIR162). In embodiments, the maize plant or plant part is not functionally fertile or is even male sterile when hemizygous and/or homozygous for a vip3 gene.

In some embodiments, the genome of the maize plant or plant part is at least about 50%, 55%, 60%, 65%, 70%, 75%, 80%, 85%, 90%, 95%, 96%, 97%, 98%, 99%, 99.5% or more identical to an elite variety of maize. For example, in some embodiments, the genome of the maize plant or plant part is at least 50%, 55%, 60%, 65%, 70%, 75%, 80%, 85%, 90%, 95%, 96%, 97%, 98%, 99%, 99.5% or more identical to that of NP2222, NP2660, NP2276, NP2391 and/or NP2460.

In some embodiments, the maize plant or plant part is the progeny of a cross between an elite variety of maize and a variety of maize that comprises an allele associated with increased fertility. For example, in some embodiments, the genome of the elite variety of maize is at least about 50%, 55%, 60%, 65%, 70%, 75%, 80%, 85%, 90%, 95%, 97%, 99% or 100% identical to that of NP2222, NP2660, NP2276, NP2391 and/or NP2460 or an elite line described in Table 11; and the genome of the variety comprising an allele associated with increased fertility is at least about 50%, 55%, 60%, 65%, 70%, 75%, 80%, 85%, 90%, 95%, 97%, 99% or 100% identical to that of NP2222, NP2660, NP2276, ID3461 or a line described in Table 11.

In some embodiments, the maize plant or plant part is the progeny of an introgression wherein the recurrent parent is an elite variety of maize and the donor comprises an allele associated with increased fertility. For example, in some embodiments, the genome of the recurrent parent is at least about 50%, 55%, 60%, 65%, 70%, 75%, 80%, 85%, 90%, 95%, 97%, 99% or 100% identical to that of NP2222, NP2660, NP2276, NP2391 and/or NP2460 or a line described in Table 11; and the genome of the donor is at least about 50%, 55%, 60%, 65%, 70%, 75%, 80%, 85%, 90%, 95%, 97%, 99% or 100% identical to that of NP2222, NP2660, NP2276, ID3461 or a line described in Table 11.

In some embodiments, the maize plant or plant part is the progeny of a cross between a first elite variety of maize (e.g., a tester line) and the progeny of a cross between a second elite variety of maize (e.g., a recurrent parent) and a variety of maize that comprises an allele associated with increased fertility (e.g., a donor). For example, in some embodiments, the genome of the first elite variety of maize is at least about 50%, 55%, 60%, 65%, 70%, 75%, 80%, 85%, 90%, 95%, 97%, 99% or 100% identical to that of NP2222, NP2660, NP2276, NP2391 and/or NP2460 or a line described in Table 11; the genome of the second elite variety of maize is at least about 50%, 55%, 60%, 65%, 70%, 75%, 80%, 85%, 90%, 95%, 97%, 99% or 100% identical to that of NP2222, NP2660, NP2276, NP2391 and/or NP2460 or a line described in Table 11; and the genome of the variety comprising an allele associated with increased fertility is at least about 50%, 55%, 60%, 65%, 70%, 75%, 80%, 85%, 90%, 95%, 97%, 99% or 100% identical to that of NP2222, NP2660, NP2276, ID3461 or a line described in Table 11.

In some embodiments, the maize plant or plant part is the progeny of a cross between a first elite variety of maize and the progeny of an introgression wherein the recurrent parent is a second elite variety of maize and the donor comprises an allele associated with increased fertility. For example, in some embodiments, the genome of the first elite variety of maize is at least about 50%, 55%, 60%, 65%, 70%, 75%, 80%, 85%, 90%, 95%, 97%, 99% or 100% identical to that of NP2222, NP2660, NP2276, NP2391 and/or NP2460 or a line described in Table 11; the genome of the recurrent parent is at least about 50%, 55%, 60%, 65%, 70%, 75%, 80%, 85%, 90%, 95%, 97%, 99% or 100% identical to that of NP2222, NP2660, NP2276, NP2391 and/or NP2460 or a line described in Table 11; and the genome of the donor is at least about 50%, 55%, 60%, 65%, 70%, 75%, 80%, 85%, 90%, 95%, 97%, 99% or 100% identical to that of NP2222, NP2660, NP2276 or ID3461 or a line described in Table 11.

In some embodiments, the maize plant or plant part comprises one or more transgenes that encode a gene product that provides resistance to one or more herbicides (e.g., glyphosate, sulfonylurea, imidazolinone, dicamba, glufisinate, phenoxy proprionic acid, cycloshexome, traizine, benzonitrile and/or broxynil).

In some embodiments, the maize plant or plant part comprises one or more transgenes that encode a gene product that provides resistance to one or more pests (e.g., one or more bacteria, one or more fungi, one or more gastropods, one or more insects, one or more nematodes, one or more oomycetes, one or more phytoplasmas, one or more protozoa and/or one or more viruses).

In some embodiments, the maize plant or plant part comprises one or more transgenes that encode a gene product that provides resistance to one or more diseases.

In some embodiments, the maize plant or plant part expresses one or more Vip3 proteins, for example, comprises a vip3 transgene in a hemizygous or homozygous state.

In some embodiments, the maize plant or plant part expresses one or more nucleic acids encoding a Vip3 protein (e.g., a Vip3A protein). Then maize plant or plant part can be hemizygous or homozygous for the nucleic acid(s) encoding the Vip3 protein(s). For example, in embodiments, the plant or plant part is hemizygous or homozygous for maize event MIR162. In some embodiments, the maize plant or plant part comprises one or more Vip nucleotide sequences as set forth by the accession numbers in Table 4.

In some embodiments, the maize plant or plant part expresses at least one nucleotide sequence that is at least about 75%, 80%, 85%, 90%, 95%, 96%, 97%, 98%, 99%, 99.5% or more identical to one or more of Vip nucleotide sequences as set forth by the accession numbers in Table 4.

In some embodiments, the maize plant or plant part expresses at least one nucleotide sequence that specifically hybridizes to the nucleotide sequence of one or more of SEQ ID NOs: 536 to 601 (as described in Table 4) under stringent hybridization conditions.

In some embodiments, the maize plant or plant part expresses at least one nucleotide sequence that encodes one or more of the Vip amino acid sequences as set forth by the accession numbers in Table 4.

In some embodiments, the maize plant or plant part expresses at least one nucleotide sequence that encodes an amino acid sequence that is at least about 75%, 80%, 85%, 90%, 95%, 96%, 97%, 98%, 99%, 99.5% or more identical to one or more of the Vip amino acid sequences as set forth by the accession numbers in Table 4.

The present invention extends to plants identified, selected and/or produced according to methods of the present invention.

The present invention also extends to products harvested from plants identified, selected and/or produced according to methods of the present invention, including, but not limited to, plant cells and harvestable plant parts including but not limited to, seeds, leaves, fruits, flowers, stems.

In some embodiments, the harvested product is a plant cell or plant part capable of producing a plant having increased fertility (e.g., increased male fertility).

The present invention also extends to products derived from plants produced according to methods of the present invention, including, but not limited to, dry pellets and powders, oils, fats, fatty acids, starches and proteins.

EXAMPLES

The following examples are not intended to be a detailed catalog of all the different ways in which the present invention may be implemented or of all the features that may be added to the present invention. Persons skilled in the art will appreciate that numerous variations and additions to the various embodiments may be made without departing from the present invention. Hence, the following descriptions are intended to illustrate some particular embodiments of the invention, and not to exhaustively specify all permutations, combinations and variations thereof.

Example 1

Development of Maiming Populations

Following the initial discovery of genetic variation in Vip3-induced reductions in male fertility, trials were conducted to characterize which inbred maize lines were most affected and which inbred maize lines were least affected by Vip3-induced reduction in male fertility.

A number of maize inbred lines homozygous for Vip3A (event MIR162) were evaluated. It was observed that male fertility was reduced in each of the Vip3A-homozygous inbred lines tested, albeit to varying degrees. See Table 9 below. Under normal growth conditions, some inbred lines (e.g., line NP2222) exhibited minimal reduction in male fertility, while others (e.g., some ID3461 lines) exhibited a significant reduction in male fertility. Indeed, several of the Vip3A-homozygous inbred lines (e.g., some NP2660 and NP2276 lines) proved to be infertile. The average reduction in male fertility was approximately 50%.

TABLE 5

Vip3A-induced reductions in male fertility vary across genetic backgrounds.

| Inbred Line | Pollen Count of Donor Parent Used to Introduce Vip3A into Inbred Line | Male Fertile? |
|---|---|---|
| B14 line 1 | good | yes |
| B37 line 1 | very poor | no |
| B37 line 2 | very good | no |
| B73 line 1 | marginal | no |
| B73 line 2 | poor | no |
| OH43 line 1 | very good | yes |
| Iodent line 1 | acceptable | no |
| Iodent line 2 | acceptable | yes |
| Iodent line 3 | very poor | yes |

It was observed that the effect of Vip3A expression was mitigated in Vip3A-hemizygous inbred lines. Inbred lines that were male infertile when homozygous for Vip3A were male fertile when hemizygous for Vip3A. Likewise, fertile inbred lines that exhibited a significant reduction in male fertility when homozygous for Vip3A were substantially or completely male fertile when hemizygous for Vip3A.

It was observed that an increase in environmental stress exacerbated the Vip3A-induced reductions in male fertility. In particular, it was observed that Vip3A-induced reductions in male fertility were more prominent in inbred lines grown under drought and/or high temperature conditions (e.g., high daytime temperatures and/or high nighttime temperatures). See FIG. 1. Vip3A-induced reductions in male fertility were also prominent in inbred lines grown under conditions comprising a large differential between daytime and nighttime temperatures. See FIG. 2.

Based upon the foregoing observations, bi-parental F2 mapping populations were developed by crossing male fertile Vip3A-expressing inbred lines (NP2222 and ID3461) with a male infertile Vip3A-expressing inbred line (NP2276) in a reciprocal manner. Because the infertile line could not be used as a male when homozygous for Vip3A, the F1 crosses in those cases were made by crossing pollen from the corresponding Vip3A-hemizygous line onto silks from male fertile inbred lines that were homozygous for Vip3A to derive the F1 plants, and then selecting the homozygous F1 plants for making the F2 seed. All F1 plants resulting from the initial crosses were sufficiently male fertile for self-pollination to make F2 seed.

Example 2

Molecular Marker Analysis and Identification of QTLs Associated with Increased Male Fertility Using NP2276 genetics crossed with NP2222 or ID3461 as described in Example 1, QTLs associated with male fertility were identified. No cytoplasmic effect was found.

F2 plants derived from the F2 seeds described in Example 1 were field-grown at Syngenta® winter nursery sites in Puerto Rico. Each F2 population consisted of ~500 plants. Each plant was phenotyped and/or scored for male fertility as described in Example 3. Each plant was tested for zygosity of the vip3A transgene (null, hemizygous, homozygous) and confirmed to be expressing the vip3A transgene at a suitable level. Each F2 plant was also genotyped using ~200 SNP markers that represented polymorphisms between the parents and with the markers spaced across the genome. QTL Cartographer software was used for analysis to identify QTLs responsive to the phenotype of interest (increased male fertility).

The LOD scores for four of the QTLs identified in this study are set forth in Table 6 below. As shown therein, a QTL identified on chromosome 5 exhibited a strong association with increased male fertility.

TABLE 6

LOD scores of QTLs identified using F2 plants from bi-parental crosses of NP2222 and NP2276 and bi-parental crosses of ID3461 and NP2276

| Chrom | NP2276/ NP2222 | NP2222/ NP2276 | NP2222/ NP2276 comb | NP2276/ ID3461 | ID3461/ NP2276 | XO/ ID comb |
|---|---|---|---|---|---|---|
| 3 | NS | 5.8 | 8.2 | 7.9 | NS | 6.2 |
| 4 | NS | 7.4 | 7.7 | (3.6) | NS | (3.6) |
| 5 | 11.1 | 8.3 | 19.9 | 14.3 | 13.0 | 23.1 |
| 10 | NS | 10.9 | 8.9 | 6.2 | 12.3 | 26.8 |

LOD significance threshold = 2.5.

Example 3

Phenotyping for Increased Male Fertility

To phenotype for increased male fertility, each F2 plant tassel was scored in the field for anther quality/quantity and pollen quantity. Those scores were combined into a single 1 to 9 Fertility Index score (see Table 7 below; a score of 1 representing the best fertility and 9 representing infertility). Because pollen quantity is a more relevant measure of male fertility; it was weighted more in the derived Fertility Index. Fertility Index scores were determined on a daily basis starting the day after a plant began to extrude anthers. On the first sign of anther extrusion, the tassel was bagged for scoring on the next two consecutive days. The highest fertility score was used in the final data analysis. Inclement weather sometimes required skipping a day, but two days of data were always collected on each plant. Anther quality was scored on a 1 to 3 scale with 1 being normal anther extrusion pattern, 2 being irregular and/or reduced anther extrusion, and 3 being no anther extrusion (complete male sterility). Pollen quantity was scored on a relative 1 to 4 scale with 1 being high pollen production and 4 being zero pollen production over the 24 hour period. Segregating Vip3A parent plants grown in the same field were used as controls to calibrate the pollen quantity determinations.

TABLE 7

Fertility Index used to score F2 plants from bi-parental crosses of NP2222and NP2276 and bi-parental crosses of ID3461 and NP2276.

| Anther Score | Pollen Score | Fertility Index |
|---|---|---|
| 1 | 1 | 1 |
| 2 | 1 | |
| 3 | 1 | |
| 1 | 2 | 2 |
| 2 | 2 | 3 |
| 3 | 2 | |
| 1 | 3 | 4 |
| 2 | 3 | 5 |
| 3 | 3 | 6 |

TABLE 7-continued

Fertility Index used to score F2 plants from bi-parental crosses of NP2222and NP2276 and bi-parental crosses of ID3461 and NP2276.

| Anther Score | Pollen Score | Fertility Index |
|---|---|---|
| 1 | 4 | 7 |
| 2 | 4 | 8 |
| 3 | 4 | 9 |

Example 4

Fine Mapping of a QTL on Chromosome 5

Inbred line NP2276 is normally highly male fertile, but is male infertile when homozygous for Vip3A. Given this large Vip3A-induced reduction in male fertility, it was decided to fine map the QTL found to have the largest effect in the F2 mapping studies (a QTL on chromosome 5) to define a smaller interval that could be used for conversion of other genetics with this fertility QTL.

Near isogenic lines (NILs) comprising an NP2222-homozygous QTL on chromosome 3 in the NP2276 genetic background were used to fine map the QTL on chromosome 5.

F1 materials from the NP2276×NP2222 crosses described in Example 1 were backcrossed with NP2276 three times and selfed multiple times with selection for maintenance of NP2222 genetics at a QTL on chromosome 3 and maintenance of both NP2222 and NP2276 genetics at a QTL on chromosome 5. The remainder of the genome outside of those two QTLs was selected for NP2276 genetics as much as possible. The QTLs on chromosome 4 and 10 were allowed to segregate back to NP2276 genetics along with the rest of the genome.

The finished NILs were grown under normal field conditions at Syngenta® winter nursery sites in Puerto Rico. NILs comprising NP2222 genetics at the QTL on chromosome 3 and the QTL on chromosome 5 exhibited relatively high male fertility, similar to null segregates of NP2276. NILs comprising NP2222 genetics at the QTL on chromosome 3 and NP2276 genetics at the QTL on chromosome 5 were male infertile. Following multiple rounds of fine mapping, the QTL on chromosome 5 was iteratively reduced to a 12.13 MB region bounded by and including positions 72,696,160 and 84,824,203 (chromosomal segment 190, as described in Table 1).

In greenhouse studies wherein pollen production was quantitated, NILs comprising NP2222 genetics at the QTL on chromosome 3 and this smaller QTL on chromosome 5 exhibited male fertility at ~80% of that measured for wild-type or null segregates of NP2276.

Example 5

Identification and Fine Mapping of QTLs Associated with Increased Male Fertility QTLs associated with increased male fertility were identified and mapped using the techniques described above with respect to Examples 1-4.

Examples of the QTLs identified are provided in Table 8.

TABLE 8

QTLs associated with increased anther quantity and/or improved anther quality.

| QTL | Chr. | cM | Left Marker | Position | Favorable Allele | Right Marker | Position | Favorable Allele | Phenotype | LOD score | % phenotypic variation explained |
|---|---|---|---|---|---|---|---|---|---|---|---|
| 3 | 3 | 151.6 | 1 | 174825991 | G | 2 | 195514453 | A | Anther Quality | 3.2 | 7.1 |
| 4-1 | 4 | 92.5 | 3 | 25326309 | G | 4 | 26400247 | G | Anther Quality/Quantity | 2.61 | 7.06 |
| 4-2 | 4 | 216.3 | 5 | 233629032 | A | 6 | 232968070 | A | Anther Quality/Quantity | Quality-20.8 Quantiry-20.3 | Quality-32.1 Quanity-32.8 |
| 5-1 | 5 | 94.9 | 7 | 181522829 | A | 8 | 77920728 | G | Anther Quality/Quantity | Quality-90.1 Quanity-84.85 | Quality-56.9 Quanity-55.7 |
| 5-2 | 5 | 147.6 | 9 | 84824103 | T | 10 | 169454950 | T | Anther Quality/Quantity | Quality-24.3 Quanity-23.3 | Qualiy-48.3 Quanity-47.9 |
| 6 | 6 | 189.3 | 11 | 165317744 | T | 12 | 165632140 | G | Anther Quality | Quality-5.2 Quanity-6.1 | Quality-7.8 Quanity-8.8 |
| 7 | 7 | 92.2 | 13 | 33157904 | G | 14 | 52027945 | A | Anther Quality/Quantity | Quality-21.0 Quantity-20.2 | Quality-32.6 Quantity-20.2 |
| 9 | 9 | 176.8 | 15 | 128947590 | A | 16 | 147896266 | C | Anther Quality/Quantity | Quality-9.9 Quanity-9.6 | Quality-14.4 Quanity-14.7 |
| 10 | 10 | 192.5 | 17 | 142092409 | G | 18 | 145273700 | G | Anther Quality | 3.25 | 6.85 |

LOD significance threshold = 2.5.

TABLE 9

Design sequences, probes and primers useful to identify the favorable alleles in the QTLs described in Table 8

| Chr | QTL | Marker | Favorable Allele | Design (SEQ ID) | Probe (SEQ ID) | Probe (SEQ ID) | Primer (SEQ ID) | Primer (SEQ ID) |
|---|---|---|---|---|---|---|---|---|
| 3 | 3 | 1 | G | 536 | 537 | 538 | 539 | 540 |
| 3 | 3 | 2 | A | 526 | 528 | 530 | 527 | 529 |
| 4 | 4-1 | 3 | G | 541 | 542 | 543 | 544 | 545 |
| 4 | 4-1 | 4 | G | 546 | 547 | 548 | 549 | 550 |
| 4 | 4-2 | 5 | A | 551 | 552 | 553 | 554 | 555 |
| 4 | 4-2 | 6 | A | 556 | 557 | 558 | 559 | 560 |
| 5 | 5-1 | 7 | A | 561 | 562 | 563 | 564 | 565 |
| 5 | 5-1 | 8 | G | 566 | 567 | 568 | 569 | 570 |
| 5 | 5-2 | 9 | T | 531 | 532 | 534 | 535 | 533 |
| 5 | 5-2 | 10 | T | 571 | 572 | 573 | 574 | 575 |
| 6 | 6 | 11 | T | 576 | 577 | 578 | 579 | 580 |
| 6 | 6 | 12 | G | 581 | 582 | 583 | | |
| 7 | 7 | 13 | G | 584 | 585 | 586 | 587 | 588 |
| 7 | 7 | 14 | A | 589 | 590 | 591 | 592 | 593 |
| 9 | 9 | 15 | A | 594 | 595 | 596 | 597 | 598 |
| 9 | 9 | 16 | C | 599 | 600 | 601 | 602 | 603 |
| 10 | 10 | 17 | G | 604 | 605 | 606 | 607 | 608 |
| 10 | 10 | 18 | G | 609 | 610 | 611 | 612 | 613 |

Inbred line B14 line 1 (see Table 8 above) was observed to comprise alleles associated with increased male fertility at QTLs on chromosomes 2, 3, 4, 5, 7, 8, 9 and 10.

Inbred lines B37 line 2 and B73 line 2 (see Table 8 above) were observed to comprise alleles associated with increased male fertility at a QTL on chromosomes 5, 7 and 9.

The predominant QTL identified in this study, which was centered around position 81,265,937 on chromosome 5, was finely mapped using a variety of markers and techniques. Following multiple rounds of fine mapping, the QTL was iteratively reduced to a 1.431 MB region bounded by and including positions 80,804,587 and 82,325,587 (chromosomal segment 7514, as described in Table 1). As shown in Table 3, that chromosomal segment encodes a number of proteins.

Example 6

Alleles Associated with QTL Intervals

A comparison was made of the SNPs present in inbred maize line NP2222 versus line NP2276 across the male fertility-associated QTL intervals in Table 8 above. The results are shown in Table 10. Where the alleles differ between the two lines, the NP2222 allele corresponds to the favorable allele.

The design of assay methods, including the design of suitable primers and probes, to detect the presence or absence of the favorable alleles identified in Table 10 in other maize plants and plant parts is readily apparent to those skilled in the art. For example, one can evaluate a sequence extending 5' and/or 3' from the indicated position of each SNP (e.g., 25, 50, 100, 150, 200, 250 nucleotides or more in the 5' and/or 3' direction) and use any of a variety of known software programs to design appropriate amplification primers and probes to detect the presence or absence of the favorable allele present in NP2222 in an amplification assay.

TABLE 10

Additional Polymorphisms in Fertility QTLs

| QTL | Chromosome | Nucleotide Position | Favorable |
|---|---|---|---|
| 3 | Chr3 | 176,322,027 | C |
| 3 | Chr3 | 184,155,559 | C |

TABLE 10-continued

Additional Polymorphisms in Fertility QTLs

| QTL | Chromosome | Nucleotide Position | Favorable |
|---|---|---|---|
| 3 | Chr3 | 184,215,519 | A |
| 3 | Chr3 | 184,672,762 | G |
| 3 | Chr3 | 185,229,529 | A |
| 3 | Chr3 | 186,563,317 | A |
| 3 | Chr3 | 187,045,835 | A |
| 3 | Chr3 | 188,335,251 | A |
| 3 | Chr3 | 189,901,375 | G |
| 3 | Chr3 | 191,195,919 | A |
| 3 | Chr3 | 193,847,182 | A |
| 4_1 | Chr4 | 25,639,678 | G |
| 4_1 | Chr4 | 25,988,159 | A |
| 4_1 | Chr4 | 26,373,200 | A |
| 4_2 | Chr4 | 232,928,019 | G |
| 4_2 | Chr4 | 232,940,724 | G |
| 4_2 | Chr4 | 233,005,187 | G |
| 4_2 | Chr4 | 233,204,685 | A |
| 4_2 | Chr4 | 233,268,189 | C |
| 5_1 | Chr5 | 78,301,966 | A |
| 5_1 | Chr5 | 81,454,989 | A |
| 5_1 | Chr5 | 82,952,810 | A |
| 5_1 | Chr5 | 83,278,003 | A |
| 5_1 AND 5_2 | Chr5 | 86,074,618 | C |
| 5_1 AND 5_2 | Chr5 | 92,369,931 | A |
| 5_1 AND 5_2 | Chr5 | 99,818,185 | A |
| 5_1 AND 5_2 | Chr5 | 107,477,545 | G |
| 5_1 AND 5_2 | Chr5 | 113,579,713 | A |
| 5_1 AND 5_2 | Chr5 | 120,984,518 | A |
| 5_1 AND 5_2 | Chr5 | 131,435,275 | G |
| 5_1 AND 5_2 | Chr5 | 141,169,239 | G |
| 5_1 AND 5_2 | Chr5 | 149,998,432 | A |
| 5_1 AND 5_2 | Chr5 | 163,409,720 | G |
| 5_1 AND 5_2 | Chr5 | 168,858,119 | A |
| 5_1 | Chr5 | 170,069,183 | A |
| 5_1 | Chr5 | 175,459,402 | G |
| 5_1 | Chr5 | 178,321,558 | A |
| 6 | Chr6 | 165,353,049 | C |
| 6 | Chr6 | 165,632,314 | C |
| 6 | Chr6 | 165,348,117 | C |
| 7 | Chr7 | 34,171,694 | C |
| 7 | Chr7 | 33,520,778 | A |
| 7 | Chr7 | 34,141,494 | G |
| 9 | Chr9 | 129,905,275 | A |
| 9 | Chr9 | 131,727,013 | A |
| 9 | Chr9 | 138,019,524 | A |
| 9 | Chr9 | 138,312,159 | C |
| 9 | Chr9 | 138,685,900 | G |
| 9 | Chr9 | 141,476,864 | G |
| 9 | Chr9 | 142,462,911 | A |
| 9 | Chr9 | 135,855,445 | A |
| 9 | Chr9 | 144,740,620 | G |
| 10 | Chr10 | 142,596,522 | A |
| 10 | Chr10 | 143,063,299 | G |
| 10 | Chr10 | 143,394,664 | G |
| 10 | Chr10 | 143,663,216 | C |
| 10 | Chr10 | 144,109,193 | A |
| 10 | Chr10 | 144,314,228 | C |
| 10 | Chr10 | 144,741,863 | G |

Example 7

Other Publicly Available Sources of Favorable Alleles

Using linear regression analysis and pairwise genetic distances, the following public lines in Table 11 from the Ames Germplasm collection are predicted to contain the favorable alleles identified in Table 8 above.

TABLE 11

Public lines predicted to contain favorable alleles.

| QTL | Public Lines Predicted to Have Favorable Allele | Probability Favorable Allele Present | Other Lines with Global Similarity |
|---|---|---|---|
| 3 | A659 | 65% | A73, A660, EP29, W22 |
| 4-1 | V102 | 86.8% | W8304, W8555 |
| 4-2 | B103 | 99.8% | OC4, PHG50, PHP76 |
| 5-1 | NC372, N192, A680 | 99.7% | PB80, TX714, NC372, B73, GEMS-0101, W8304 |
| 5-2 | NC372, N192, A680 | 99.7% | PB80, TX714, NC372, B73, GEMS-0101, W8304 |
| 6 | B104, NC268, NC306, NC310, NC372 | 99.8% | B121, B110, NC306, NC268A, NC312, NC308, NC326, PB80, TX714 |
| 7 | ND253, LH52 | 99.8%, 99.2% | ND264, S117, MO17, MO17T, SeagullSeventeen |
| 9 | Pa762 | 97% | R218, R219, VEN981, SAN349a-1, OH43T, OH43 |
| 10 | DE1 | 96.2% | DE2, PHP02, MS81, MS75 |

Example 8

Producing Vip3A-Expressing Maize Plants with Increased Male Fertility

Chromosomal segment 13 (as described in Table 1) is introgressed from NP2222 into aVip3A-homozygous inbred line (e.g., a MIR162 inbred line). The introgressed maize line exhibits increased male fertility as compared to its recurrent parent. In particular, the introgressed maize line exhibits increased pollen production, increased anther production and improved anther morphology under normal growth conditions or environmental stress conditions (e.g., drought and/or high temperature stress conditions). The beneficial effects of the introgressed chromosomal segment are more pronounced in plants grown under high temperature conditions (e.g., high daytime and/or nighttime temperatures).

Example 9

Producing Vip3A-Expressing Maize Plants with Increased Male Fertility

Chromosomal segment 13 (as described in Table 1) is introgressed from NP2660 into aVip3A-homozygous inbred line (e.g., a MIR162 inbred line). The introgressed maize line exhibits increased male fertility as compared to its recurrent parent. In particular, the introgressed maize line exhibits increased pollen production, increased anther production and improved anther morphology under normal growth conditions or environmental stress conditions (e.g., drought and/or high temperature stress conditions). The beneficial effects of the introgressed chromosomal segment are more pronounced in plants grown under high temperature conditions (e.g., high daytime and/or nighttime temperatures).

Example 10

Producing Vip3A-Expressing Maize Plants with Increased Male Fertility

Chromosomal segment 43 (as described in Table 1) is introgressed from NP2222 into aVip3A-homozygous inbred line (e.g., a MIR162 inbred line). The introgressed maize line exhibits increased male fertility as compared to its recurrent parent. In particular, the introgressed maize line exhibits increased pollen production, increased anther production and improved anther morphology under normal growth conditions or environmental stress conditions (e.g., drought and/or high temperature stress conditions). The beneficial effects of the introgressed chromosomal segment are more pronounced in plants grown under high temperature conditions (e.g., high daytime and/or nighttime temperatures).

Example 11

Producing Vip3A-Expressing Maize Plants with Increased Male Fertility

Chromosomal segment 43 (as described in Table 1) is introgressed from NP2660 into aVip3A-homozygous inbred line (e.g., a MIR162 inbred line). The introgressed maize line exhibits increased male fertility as compared to its recurrent parent. In particular, the introgressed maize line exhibits increased pollen production, increased anther production and improved anther morphology under normal growth conditions or environmental stress conditions (e.g., drought and/or high temperature stress conditions). The beneficial effects of the introgressed chromosomal segment are more pronounced in plants grown under high temperature conditions (e.g., high daytime and/or nighttime temperatures).

Example 12

Producing Vip3A-Expressing Maize Plants with Increased Male Fertility

Chromosomal segment 7514 (as described in Table 1) is introgressed from NP2222 into aVip3A-homozygous inbred line (e.g., a MIR162 inbred line). The introgressed maize line exhibits increased male fertility as compared to its recurrent parent. In particular, the introgressed maize line exhibits increased pollen production, increased anther production and improved anther morphology under normal growth conditions or environmental stress conditions (e.g., drought and/or high temperature stress conditions). The beneficial effects of the introgressed chromosomal segment are more pronounced in plants grown under high temperature conditions (e.g., high daytime and/or nighttime temperatures).

Example 13

Producing Vip3A-Expressing Maize Plants with Increased Male Fertility

Chromosomal segment 7514 (as described in Table 1) is introgressed from NP2660 into aVip3A-homozygous inbred line (e.g., a MIR162 inbred line). The introgressed maize line exhibits increased male fertility as compared to its recurrent parent. In particular, the introgressed maize line exhibits increased pollen production, increased anther production and improved anther morphology under normal growth conditions or environmental stress conditions (e.g., drought and/or high temperature stress conditions). The beneficial effects of the introgressed chromosomal segment are more pronounced in plants grown under high temperature conditions (e.g., high daytime and/or nighttime temperatures).

Example 14

Producing Vip3A-Expressing Maize Plants with Increased Male Fertility

Chromosomal segment 7514 (as described in Table 1) is introgressed from NP2276 into aVip3A-homozygous inbred line (e.g., a MIR162 inbred line). The introgressed maize line exhibits increased male fertility as compared to its recurrent parent. In particular, the introgressed maize line exhibits increased pollen production, increased anther production and improved anther morphology under normal growth conditions or environmental stress conditions (e.g., drought and/or high temperature stress conditions). The beneficial effects of the introgressed chromosomal segment are more pronounced in plants grown under high temperature conditions (e.g., high daytime and/or nighttime temperatures).

Example 15

Producing Vip3A-Expressing Maize Plants with Increased Male Fertility

Chromosomal segment 12747 (as described in Table 1) is introgressed from NP2222 into aVip3A-homozygous inbred line (e.g., a MIR162 inbred line). The introgressed maize line exhibits increased male fertility as compared to its recurrent parent. In particular, the introgressed maize line exhibits increased pollen production, increased anther production and improved anther morphology under normal growth conditions or environmental stress conditions (e.g., drought and/or high temperature stress conditions). The beneficial effects of the introgressed chromosomal segment are more pronounced in plants grown under high temperature conditions (e.g., high daytime and/or nighttime temperatures).

Example 16

Producing Vip3A-Expressing Maize Plants with Increased Male Fertility

Chromosomal segment 12747 (as described in Table 1) is introgressed from NP2660 into aVip3A-homozygous inbred line (e.g., a MIR162 inbred line). The introgressed maize line exhibits increased male fertility as compared to its recurrent parent. In particular, the introgressed maize line exhibits increased pollen production, increased anther production and improved anther morphology under normal growth conditions or environmental stress conditions (e.g., drought and/or high temperature stress conditions). The beneficial effects of the introgressed chromosomal segment are more pronounced in plants grown under high temperature conditions (e.g., high daytime and/or nighttime temperatures).

Example 17

Producing Vip3A-Expressing Maize Plants with Increased Male Fertility

Chromosomal segment 12753 (as described in Table 1) is introgressed from NP2222 into aVip3A-homozygous inbred line (e.g., a MIR162 inbred line). The introgressed maize line exhibits increased male fertility as compared to its recurrent parent. In particular, the introgressed maize line

Example 18

Producing Vip3A-Expressing Maize Plants with Increased Male Fertility

Chromosomal segment 12753 (as described in Table 1) is introgressed from NP2660 into aVip3A-homozygous inbred line (e.g., a MIR162 inbred line). The introgressed maize line exhibits increased male fertility as compared to its recurrent parent. In particular, the introgressed maize line exhibits increased pollen production, increased anther production and improved anther morphology under normal growth conditions or environmental stress conditions (e.g., drought and/or high temperature stress conditions). The beneficial effects of the introgressed chromosomal segment are more pronounced in plants grown under high temperature conditions (e.g., high daytime and/or nighttime temperatures).

Example 19

Producing Vip3A-Expressing Maize Plants with Increased Male Fertility

Chromosomal segment 12760 (as described in Table 1) is introgressed from NP2222 into aVip3A-homozygous inbred line (e.g., a MIR162 inbred line). The introgressed maize line exhibits increased male fertility as compared to its recurrent parent. In particular, the introgressed maize line exhibits increased pollen production, increased anther production and improved anther morphology under normal growth conditions or environmental stress conditions (e.g., drought and/or high temperature stress conditions). The beneficial effects of the introgressed chromosomal segment are more pronounced in plants grown under high temperature conditions (e.g., high daytime and/or nighttime temperatures).

Example 20

Producing Vip3A-Expressing Maize Plants with Increased Male Fertility

Chromosomal segment 12760 (as described in Table 1) is introgressed from NP2660 into aVip3A-homozygous inbred line (e.g., a MIR162 inbred line). The introgressed maize line exhibits increased male fertility as compared to its recurrent parent. In particular, the introgressed maize line exhibits increased pollen production, increased anther production and improved anther morphology under normal growth conditions or environmental stress conditions (e.g., drought and/or high temperature stress conditions). The beneficial effects of the introgressed chromosomal segment are more pronounced in plants grown under high temperature conditions (e.g., high daytime and/or nighttime temperatures).

Example 21

Producing Vip3A-Expressing Maize Plants with Increased Male Fertility

Chromosomal segment 12760 (as described in Table 1) is introgressed from NP2276 into aVip3A-homozygous inbred line (e.g., a MIR162 inbred line). The introgressed maize line exhibits increased male fertility as compared to its recurrent parent. In particular, the introgressed maize line exhibits increased pollen production, increased anther production and improved anther morphology under normal growth conditions or environmental stress conditions (e.g., drought and/or high temperature stress conditions). The beneficial effects of the introgressed chromosomal segment are more pronounced in plants grown under high temperature conditions (e.g., high daytime and/or nighttime temperatures).

TABLE 1

Examples of chromosomal segments associated with increased fertility in maize.

| Chromosomal Segment | Chr. | Boundary 1 | Boundary 2 |
| --- | --- | --- | --- |
| 1 | 1 | 39248635 | 198733255 |
| 2 | 2 | | |
| 3 | 3 | 7411453 | 168481421 |
| 4 | 3 | 7411453 | 174825991 |
| 5 | 3 | 7411453 | 184816495 |
| 6 | 3 | 7411453 | 195514453 |
| 7 | 3 | 7411453 | 213804184 |
| 8 | 3 | 168481421 | 174825991 |
| 9 | 3 | 168481421 | 184816495 |
| 10 | 3 | 168481421 | 195514453 |
| 11 | 3 | 168481421 | 213804184 |
| 12 | 3 | 174825991 | 184816495 |
| 13 | 3 | 174825991 | 195514453 |
| 14 | 3 | 174825991 | 213804184 |
| 15 | 3 | 184816495 | 195514453 |
| 16 | 3 | 184816495 | 213804184 |
| 17 | 3 | 195514453 | 213804184 |
| 18 | 4 | 9852206 | 25326309 |
| 19 | 4 | 9852206 | 26400247 |
| 20 | 4 | 9852206 | 182010511 |
| 21 | 4 | 9852206 | 216707012 |
| 22 | 4 | 9852206 | 232968070 |
| 23 | 4 | 9852206 | 233629032 |
| 24 | 4 | 9852206 | 238991842 |
| 25 | 4 | 25326309 | 26400247 |
| 26 | 4 | 25326309 | 182010511 |
| 27 | 4 | 25326309 | 216707012 |
| 28 | 4 | 25326309 | 232968070 |
| 29 | 4 | 25326309 | 233629032 |
| 30 | 4 | 25326309 | 238991842 |
| 31 | 4 | 26400247 | 182010511 |
| 32 | 4 | 26400247 | 216707012 |
| 33 | 4 | 26400247 | 232968070 |
| 34 | 4 | 26400247 | 233629032 |
| 35 | 4 | 26400247 | 238991842 |
| 36 | 4 | 182010511 | 216707012 |
| 37 | 4 | 182010511 | 232968070 |
| 38 | 4 | 182010511 | 233629032 |
| 39 | 4 | 182010511 | 238991842 |
| 40 | 4 | 216707012 | 232968070 |
| 41 | 4 | 216707012 | 233629032 |
| 42 | 4 | 216707012 | 238991842 |
| 43 | 4 | 232968070 | 233629032 |
| 44 | 4 | 232968070 | 238991842 |
| 45 | 4 | 233629032 | 238991842 |
| 46 | 5 | 72696160 | 73132763 |
| 47 | 5 | 72696160 | 74614332 |
| 48 | 5 | 72696160 | 78022476 |
| 49 | 5 | 72696160 | 78023096 |
| 50 | 5 | 72696160 | 78131652 |

TABLE 1-continued

Examples of chromosomal segments associated with increased fertility in maize.

| Chromosomal Segment | Chr. | Boundary 1 | Boundary 2 |
| --- | --- | --- | --- |
| 51 | 5 | 72696160 | 78131784 |
| 52 | 5 | 72696160 | 78310499 |
| 53 | 5 | 72696160 | 78381593 |
| 54 | 5 | 72696160 | 78389884 |
| 55 | 5 | 72696160 | 78520683 |
| 56 | 5 | 72696160 | 78765635 |
| 57 | 5 | 72696160 | 78780292 |
| 58 | 5 | 72696160 | 78813114 |
| 59 | 5 | 72696160 | 78814710 |
| 60 | 5 | 72696160 | 78814976 |
| 61 | 5 | 72696160 | 78815306 |
| 62 | 5 | 72696160 | 78821393 |
| 63 | 5 | 72696160 | 78826528 |
| 64 | 5 | 72696160 | 78826538 |
| 65 | 5 | 72696160 | 78826612 |
| 66 | 5 | 72696160 | 78918620 |
| 67 | 5 | 72696160 | 78918850 |
| 68 | 5 | 72696160 | 79056960 |
| 69 | 5 | 72696160 | 79163631 |
| 70 | 5 | 72696160 | 79176557 |
| 71 | 5 | 72696160 | 79188028 |
| 72 | 5 | 72696160 | 79201760 |
| 73 | 5 | 72696160 | 79230005 |
| 74 | 5 | 72696160 | 79230318 |
| 75 | 5 | 72696160 | 79505592 |
| 76 | 5 | 72696160 | 79510072 |
| 77 | 5 | 72696160 | 79538012 |
| 78 | 5 | 72696160 | 79538048 |
| 79 | 5 | 72696160 | 79538367 |
| 80 | 5 | 72696160 | 79669824 |
| 81 | 5 | 72696160 | 79682242 |
| 82 | 5 | 72696160 | 79699261 |
| 83 | 5 | 72696160 | 79710673 |
| 84 | 5 | 72696160 | 79861902 |
| 85 | 5 | 72696160 | 79867710 |
| 86 | 5 | 72696160 | 79867868 |
| 87 | 5 | 72696160 | 79867873 |
| 88 | 5 | 72696160 | 79961961 |
| 89 | 5 | 72696160 | 80086268 |
| 90 | 5 | 72696160 | 80190673 |
| 91 | 5 | 72696160 | 80190777 |
| 92 | 5 | 72696160 | 80192546 |
| 93 | 5 | 72696160 | 80195395 |
| 94 | 5 | 72696160 | 80199923 |
| 95 | 5 | 72696160 | 80241911 |
| 96 | 5 | 72696160 | 80282785 |
| 97 | 5 | 72696160 | 80345337 |
| 98 | 5 | 72696160 | 80389787 |
| 99 | 5 | 72696160 | 80411639 |
| 100 | 5 | 72696160 | 80446855 |
| 101 | 5 | 72696160 | 80492790 |
| 102 | 5 | 72696160 | 80670554 |
| 103 | 5 | 72696160 | 80674679 |
| 104 | 5 | 72696160 | 80720509 |
| 105 | 5 | 72696160 | 80800856 |
| 106 | 5 | 72696160 | 80804587 |
| 107 | 5 | 72696160 | 80807409 |
| 108 | 5 | 72696160 | 80835734 |
| 109 | 5 | 72696160 | 80835734 |
| 110 | 5 | 72696160 | 80971764 |
| 111 | 5 | 72696160 | 80972258 |
| 112 | 5 | 72696160 | 80974450 |
| 113 | 5 | 72696160 | 81047638 |
| 114 | 5 | 72696160 | 81082921 |
| 115 | 5 | 72696160 | 81157909 |
| 116 | 5 | 72696160 | 81265937 |
| 117 | 5 | 72696160 | 81267485 |
| 118 | 5 | 72696160 | 81267499 |
| 119 | 5 | 72696160 | 81274512 |
| 120 | 5 | 72696160 | 81763618 |
| 121 | 5 | 72696160 | 81797217 |
| 122 | 5 | 72696160 | 81800186 |
| 123 | 5 | 72696160 | 81806213 |
| 124 | 5 | 72696160 | 81854583 |
| 125 | 5 | 72696160 | 81859374 |
| 126 | 5 | 72696160 | 81861368 |
| 127 | 5 | 72696160 | 81863686 |
| 128 | 5 | 72696160 | 81916850 |
| 129 | 5 | 72696160 | 81954891 |
| 130 | 5 | 72696160 | 81985250 |
| 131 | 5 | 72696160 | 82083752 |
| 132 | 5 | 72696160 | 82101253 |
| 133 | 5 | 72696160 | 82143124 |
| 134 | 5 | 72696160 | 82236318 |
| 135 | 5 | 72696160 | 82325587 |
| 136 | 5 | 72696160 | 82427210 |
| 137 | 5 | 72696160 | 82431853 |
| 138 | 5 | 72696160 | 82446714 |
| 139 | 5 | 72696160 | 82446794 |
| 140 | 5 | 72696160 | 82551111 |
| 141 | 5 | 72696160 | 82552090 |
| 142 | 5 | 72696160 | 82555641 |
| 143 | 5 | 72696160 | 82555670 |
| 144 | 5 | 72696160 | 82556511 |
| 145 | 5 | 72696160 | 82559047 |
| 146 | 5 | 72696160 | 82561535 |
| 147 | 5 | 72696160 | 82610100 |
| 148 | 5 | 72696160 | 82676822 |
| 149 | 5 | 72696160 | 82676901 |
| 150 | 5 | 72696160 | 82883691 |
| 151 | 5 | 72696160 | 82954942 |
| 152 | 5 | 72696160 | 82971688 |
| 153 | 5 | 72696160 | 83023965 |
| 154 | 5 | 72696160 | 83094205 |
| 155 | 5 | 72696160 | 83146355 |
| 156 | 5 | 72696160 | 83280630 |
| 157 | 5 | 72696160 | 83281412 |
| 158 | 5 | 72696160 | 83400242 |
| 159 | 5 | 72696160 | 83405797 |
| 160 | 5 | 72696160 | 83437132 |
| 161 | 5 | 72696160 | 83522252 |
| 162 | 5 | 72696160 | 83560095 |
| 163 | 5 | 72696160 | 83560204 |
| 164 | 5 | 72696160 | 83572400 |
| 165 | 5 | 72696160 | 83607661 |
| 166 | 5 | 72696160 | 83745342 |
| 167 | 5 | 72696160 | 83861275 |
| 168 | 5 | 72696160 | 83861633 |
| 169 | 5 | 72696160 | 83865653 |
| 170 | 5 | 72696160 | 83865914 |
| 171 | 5 | 72696160 | 83865920 |
| 172 | 5 | 72696160 | 83868010 |
| 173 | 5 | 72696160 | 84019752 |
| 174 | 5 | 72696160 | 84065912 |
| 175 | 5 | 72696160 | 84086632 |
| 176 | 5 | 72696160 | 84089603 |
| 177 | 5 | 72696160 | 84104814 |
| 178 | 5 | 72696160 | 84105175 |
| 179 | 5 | 72696160 | 84251635 |
| 180 | 5 | 72696160 | 84252180 |
| 181 | 5 | 72696160 | 84253030 |
| 182 | 5 | 72696160 | 84254208 |
| 183 | 5 | 72696160 | 84314930 |
| 184 | 5 | 72696160 | 84340523 |
| 185 | 5 | 72696160 | 84516340 |
| 186 | 5 | 72696160 | 84706916 |
| 187 | 5 | 72696160 | 84799488 |
| 188 | 5 | 72696160 | 84801081 |
| 189 | 5 | 72696160 | 84824103 |
| 190 | 5 | 72696160 | 84824203 |
| 191 | 5 | 72696160 | 84824816 |
| 192 | 5 | 72696160 | 84825422 |
| 193 | 5 | 72696160 | 84825763 |
| 194 | 5 | 72696160 | 84825942 |
| 195 | 5 | 72696160 | 84936441 |
| 196 | 5 | 72696160 | 84936493 |
| 197 | 5 | 72696160 | 84943705 |
| 198 | 5 | 72696160 | 169454950 |

TABLE 1-continued

Examples of chromosomal segments associated with increased fertility in maize.

| Chromosomal Segment | Chr. | Boundary 1 | Boundary 2 |
|---|---|---|---|
| 199 | 5 | 72696160 | 181522829 |
| 200 | 5 | 72696160 | 204759879 |
| 201 | 5 | 72696160 | 209874191 |
| 202 | 5 | 73132763 | 74614332 |
| 203 | 5 | 74614332 | 78022476 |
| 204 | 5 | 74614332 | 78023096 |
| 205 | 5 | 74614332 | 78131652 |
| 206 | 5 | 74614332 | 78131784 |
| 207 | 5 | 74614332 | 78310499 |
| 208 | 5 | 74614332 | 78381593 |
| 209 | 5 | 74614332 | 78389884 |
| 210 | 5 | 74614332 | 78520683 |
| 211 | 5 | 74614332 | 78765635 |
| 212 | 5 | 74614332 | 78780292 |
| 213 | 5 | 74614332 | 78813114 |
| 214 | 5 | 74614332 | 78814710 |
| 215 | 5 | 74614332 | 78814976 |
| 216 | 5 | 74614332 | 78815306 |
| 217 | 5 | 74614332 | 78821393 |
| 218 | 5 | 74614332 | 78826528 |
| 219 | 5 | 74614332 | 78826538 |
| 220 | 5 | 74614332 | 78826612 |
| 221 | 5 | 74614332 | 78918620 |
| 222 | 5 | 74614332 | 78918850 |
| 223 | 5 | 74614332 | 79056960 |
| 224 | 5 | 74614332 | 79163631 |
| 225 | 5 | 74614332 | 79176557 |
| 226 | 5 | 74614332 | 79188028 |
| 227 | 5 | 74614332 | 79201760 |
| 228 | 5 | 74614332 | 79230005 |
| 229 | 5 | 74614332 | 79230318 |
| 230 | 5 | 74614332 | 79505592 |
| 231 | 5 | 74614332 | 79510072 |
| 232 | 5 | 74614332 | 79538012 |
| 233 | 5 | 74614332 | 79538048 |
| 234 | 5 | 74614332 | 79538367 |
| 235 | 5 | 74614332 | 79669824 |
| 236 | 5 | 74614332 | 79682242 |
| 237 | 5 | 74614332 | 79699261 |
| 238 | 5 | 74614332 | 79710673 |
| 239 | 5 | 74614332 | 79861902 |
| 240 | 5 | 74614332 | 79867710 |
| 241 | 5 | 74614332 | 79867868 |
| 242 | 5 | 74614332 | 79867873 |
| 243 | 5 | 74614332 | 79961961 |
| 244 | 5 | 74614332 | 80086268 |
| 245 | 5 | 74614332 | 80190673 |
| 246 | 5 | 74614332 | 80190777 |
| 247 | 5 | 74614332 | 80192546 |
| 248 | 5 | 74614332 | 80195395 |
| 249 | 5 | 74614332 | 80199923 |
| 250 | 5 | 74614332 | 80241911 |
| 251 | 5 | 74614332 | 80282785 |
| 252 | 5 | 74614332 | 80345337 |
| 253 | 5 | 74614332 | 80389787 |
| 254 | 5 | 74614332 | 80411639 |
| 255 | 5 | 74614332 | 80446855 |
| 256 | 5 | 74614332 | 80492790 |
| 257 | 5 | 74614332 | 80670554 |
| 258 | 5 | 74614332 | 80674679 |
| 259 | 5 | 74614332 | 80720509 |
| 260 | 5 | 74614332 | 80800856 |
| 261 | 5 | 74614332 | 80804587 |
| 262 | 5 | 74614332 | 80807409 |
| 263 | 5 | 74614332 | 80835734 |
| 264 | 5 | 74614332 | 80835734 |
| 265 | 5 | 74614332 | 80971764 |
| 266 | 5 | 74614332 | 80972258 |
| 267 | 5 | 74614332 | 80974450 |
| 268 | 5 | 74614332 | 81047638 |
| 269 | 5 | 74614332 | 81082921 |
| 270 | 5 | 74614332 | 81157909 |
| 271 | 5 | 74614332 | 81265937 |
| 272 | 5 | 74614332 | 81267485 |
| 273 | 5 | 74614332 | 81267499 |
| 274 | 5 | 74614332 | 81274512 |
| 275 | 5 | 74614332 | 81763618 |
| 276 | 5 | 74614332 | 81797217 |
| 277 | 5 | 74614332 | 81800186 |
| 278 | 5 | 74614332 | 81806213 |
| 279 | 5 | 74614332 | 81854583 |
| 280 | 5 | 74614332 | 81859374 |
| 281 | 5 | 74614332 | 81861368 |
| 282 | 5 | 74614332 | 81863686 |
| 283 | 5 | 74614332 | 81916850 |
| 284 | 5 | 74614332 | 81954891 |
| 285 | 5 | 74614332 | 81985250 |
| 286 | 5 | 74614332 | 82083752 |
| 287 | 5 | 74614332 | 82101253 |
| 288 | 5 | 74614332 | 82143124 |
| 289 | 5 | 74614332 | 82236318 |
| 290 | 5 | 74614332 | 82325587 |
| 291 | 5 | 74614332 | 82427210 |
| 292 | 5 | 74614332 | 82431853 |
| 293 | 5 | 74614332 | 82446714 |
| 294 | 5 | 74614332 | 82446794 |
| 295 | 5 | 74614332 | 82551111 |
| 296 | 5 | 74614332 | 82552090 |
| 297 | 5 | 74614332 | 82555641 |
| 298 | 5 | 74614332 | 82555670 |
| 299 | 5 | 74614332 | 82556511 |
| 300 | 5 | 74614332 | 82559047 |
| 301 | 5 | 74614332 | 82561535 |
| 302 | 5 | 74614332 | 82610100 |
| 303 | 5 | 74614332 | 82676822 |
| 304 | 5 | 74614332 | 82676901 |
| 305 | 5 | 74614332 | 82883691 |
| 306 | 5 | 74614332 | 82954942 |
| 307 | 5 | 74614332 | 82971688 |
| 308 | 5 | 74614332 | 83023965 |
| 309 | 5 | 74614332 | 83094205 |
| 310 | 5 | 74614332 | 83146355 |
| 311 | 5 | 74614332 | 83280630 |
| 312 | 5 | 74614332 | 83281412 |
| 313 | 5 | 74614332 | 83400242 |
| 314 | 5 | 74614332 | 83405797 |
| 315 | 5 | 74614332 | 83437132 |
| 316 | 5 | 74614332 | 83522252 |
| 317 | 5 | 74614332 | 83560095 |
| 318 | 5 | 74614332 | 83560204 |
| 319 | 5 | 74614332 | 83572400 |
| 320 | 5 | 74614332 | 83607661 |
| 321 | 5 | 74614332 | 83745342 |
| 322 | 5 | 74614332 | 83861275 |
| 323 | 5 | 74614332 | 83861633 |
| 324 | 5 | 74614332 | 83865653 |
| 325 | 5 | 74614332 | 83865914 |
| 326 | 5 | 74614332 | 83865920 |
| 327 | 5 | 74614332 | 83868010 |
| 328 | 5 | 74614332 | 84019752 |
| 329 | 5 | 74614332 | 84065912 |
| 330 | 5 | 74614332 | 84086632 |
| 331 | 5 | 74614332 | 84089603 |
| 332 | 5 | 74614332 | 84104814 |
| 333 | 5 | 74614332 | 84105175 |
| 334 | 5 | 74614332 | 84251635 |
| 335 | 5 | 74614332 | 84252180 |
| 336 | 5 | 74614332 | 84253030 |
| 337 | 5 | 74614332 | 84254208 |
| 338 | 5 | 74614332 | 84314930 |
| 339 | 5 | 74614332 | 84340523 |
| 340 | 5 | 74614332 | 84516340 |
| 341 | 5 | 74614332 | 84706916 |
| 342 | 5 | 74614332 | 84799488 |
| 343 | 5 | 74614332 | 84801081 |
| 344 | 5 | 74614332 | 84824103 |
| 345 | 5 | 74614332 | 84824203 |
| 346 | 5 | 74614332 | 84824816 |

TABLE 1-continued

Examples of chromosomal segments associated with increased fertility in maize.

| Chromosomal Segment | Chr. | Boundary 1 | Boundary 2 |
|---|---|---|---|
| 347 | 5 | 74614332 | 84825422 |
| 348 | 5 | 74614332 | 84825763 |
| 349 | 5 | 74614332 | 84825942 |
| 350 | 5 | 74614332 | 84936441 |
| 351 | 5 | 74614332 | 84936493 |
| 352 | 5 | 74614332 | 84943705 |
| 353 | 5 | 74614332 | 169454950 |
| 354 | 5 | 74614332 | 181522829 |
| 355 | 5 | 74614332 | 204759879 |
| 356 | 5 | 74614332 | 209874191 |
| 357 | 5 | 74614332 | 78022476 |
| 358 | 5 | 74614332 | 78023096 |
| 359 | 5 | 74614332 | 78131652 |
| 360 | 5 | 74614332 | 78131784 |
| 361 | 5 | 74614332 | 78310499 |
| 362 | 5 | 74614332 | 78381593 |
| 363 | 5 | 74614332 | 78389884 |
| 364 | 5 | 74614332 | 78520683 |
| 365 | 5 | 74614332 | 78765635 |
| 366 | 5 | 74614332 | 78780292 |
| 367 | 5 | 74614332 | 78813114 |
| 368 | 5 | 74614332 | 78814710 |
| 369 | 5 | 74614332 | 78814976 |
| 370 | 5 | 74614332 | 78815306 |
| 371 | 5 | 74614332 | 78821393 |
| 372 | 5 | 74614332 | 78826528 |
| 373 | 5 | 74614332 | 78826538 |
| 374 | 5 | 74614332 | 78826612 |
| 375 | 5 | 74614332 | 78918620 |
| 376 | 5 | 74614332 | 78918850 |
| 377 | 5 | 74614332 | 79056960 |
| 378 | 5 | 74614332 | 79163631 |
| 379 | 5 | 74614332 | 79176557 |
| 380 | 5 | 74614332 | 79188028 |
| 381 | 5 | 74614332 | 79201760 |
| 382 | 5 | 74614332 | 79230005 |
| 383 | 5 | 74614332 | 79230318 |
| 384 | 5 | 74614332 | 79505592 |
| 385 | 5 | 74614332 | 79510072 |
| 386 | 5 | 74614332 | 79538012 |
| 387 | 5 | 74614332 | 79538048 |
| 388 | 5 | 74614332 | 79538367 |
| 389 | 5 | 74614332 | 79669824 |
| 390 | 5 | 74614332 | 79682242 |
| 391 | 5 | 74614332 | 79699261 |
| 392 | 5 | 74614332 | 79710673 |
| 393 | 5 | 74614332 | 79861902 |
| 394 | 5 | 74614332 | 79867710 |
| 395 | 5 | 74614332 | 79867868 |
| 396 | 5 | 74614332 | 79867873 |
| 397 | 5 | 74614332 | 79961961 |
| 398 | 5 | 74614332 | 80086268 |
| 399 | 5 | 74614332 | 80190673 |
| 400 | 5 | 74614332 | 80190777 |
| 401 | 5 | 74614332 | 80192546 |
| 402 | 5 | 74614332 | 80195395 |
| 403 | 5 | 74614332 | 80199923 |
| 404 | 5 | 74614332 | 80241911 |
| 405 | 5 | 74614332 | 80282785 |
| 406 | 5 | 74614332 | 80345337 |
| 407 | 5 | 74614332 | 80389787 |
| 408 | 5 | 74614332 | 80411639 |
| 409 | 5 | 74614332 | 80446855 |
| 410 | 5 | 74614332 | 80492790 |
| 411 | 5 | 74614332 | 80670554 |
| 412 | 5 | 74614332 | 80674679 |
| 413 | 5 | 74614332 | 80720509 |
| 414 | 5 | 74614332 | 80800856 |
| 415 | 5 | 74614332 | 80804587 |
| 416 | 5 | 74614332 | 80807409 |
| 417 | 5 | 74614332 | 80835734 |
| 418 | 5 | 74614332 | 80835734 |
| 419 | 5 | 74614332 | 80971764 |
| 420 | 5 | 74614332 | 80972258 |
| 421 | 5 | 74614332 | 80974450 |
| 422 | 5 | 74614332 | 81047638 |
| 423 | 5 | 74614332 | 81082921 |
| 424 | 5 | 74614332 | 81157909 |
| 425 | 5 | 74614332 | 81265937 |
| 426 | 5 | 74614332 | 81267485 |
| 427 | 5 | 74614332 | 81267499 |
| 428 | 5 | 74614332 | 81274512 |
| 429 | 5 | 74614332 | 81763618 |
| 430 | 5 | 74614332 | 81797217 |
| 431 | 5 | 74614332 | 81800186 |
| 432 | 5 | 74614332 | 81806213 |
| 433 | 5 | 74614332 | 81854583 |
| 434 | 5 | 74614332 | 81859374 |
| 435 | 5 | 74614332 | 81861368 |
| 436 | 5 | 74614332 | 81863686 |
| 437 | 5 | 74614332 | 81916850 |
| 438 | 5 | 74614332 | 81954891 |
| 439 | 5 | 74614332 | 81985250 |
| 440 | 5 | 74614332 | 82083752 |
| 441 | 5 | 74614332 | 82101253 |
| 442 | 5 | 74614332 | 82143124 |
| 443 | 5 | 74614332 | 82236318 |
| 444 | 5 | 74614332 | 82325587 |
| 445 | 5 | 74614332 | 82427210 |
| 446 | 5 | 74614332 | 82431853 |
| 447 | 5 | 74614332 | 82446714 |
| 448 | 5 | 74614332 | 82446794 |
| 449 | 5 | 74614332 | 82551111 |
| 450 | 5 | 74614332 | 82552090 |
| 451 | 5 | 74614332 | 82555641 |
| 452 | 5 | 74614332 | 82555670 |
| 453 | 5 | 74614332 | 82556511 |
| 454 | 5 | 74614332 | 82559047 |
| 455 | 5 | 74614332 | 82561535 |
| 456 | 5 | 74614332 | 82610100 |
| 457 | 5 | 74614332 | 82676822 |
| 458 | 5 | 74614332 | 82676901 |
| 459 | 5 | 74614332 | 82883691 |
| 460 | 5 | 74614332 | 82954942 |
| 461 | 5 | 74614332 | 82971688 |
| 462 | 5 | 74614332 | 83023965 |
| 463 | 5 | 74614332 | 83094205 |
| 464 | 5 | 74614332 | 83146355 |
| 465 | 5 | 74614332 | 83280630 |
| 466 | 5 | 74614332 | 83281412 |
| 467 | 5 | 74614332 | 83400242 |
| 468 | 5 | 74614332 | 83405797 |
| 469 | 5 | 74614332 | 83437132 |
| 470 | 5 | 74614332 | 83522252 |
| 471 | 5 | 74614332 | 83560095 |
| 472 | 5 | 74614332 | 83560204 |
| 473 | 5 | 74614332 | 83572400 |
| 474 | 5 | 74614332 | 83607661 |
| 475 | 5 | 74614332 | 83745342 |
| 476 | 5 | 74614332 | 83861275 |
| 477 | 5 | 74614332 | 83861633 |
| 478 | 5 | 74614332 | 83865653 |
| 479 | 5 | 74614332 | 83865914 |
| 480 | 5 | 74614332 | 83865920 |
| 481 | 5 | 74614332 | 83868010 |
| 482 | 5 | 74614332 | 84019752 |
| 483 | 5 | 74614332 | 84065912 |
| 484 | 5 | 74614332 | 84086632 |
| 485 | 5 | 74614332 | 84089603 |
| 486 | 5 | 74614332 | 84104814 |
| 487 | 5 | 74614332 | 84105175 |
| 488 | 5 | 74614332 | 84251635 |
| 489 | 5 | 74614332 | 84252180 |
| 490 | 5 | 74614332 | 84253030 |
| 491 | 5 | 74614332 | 84254208 |
| 492 | 5 | 74614332 | 84314930 |
| 493 | 5 | 74614332 | 84340523 |
| 494 | 5 | 74614332 | 84516340 |

TABLE 1-continued

Examples of chromosomal segments associated with increased fertility in maize.

| Chromosomal Segment | Chr. | Boundary 1 | Boundary 2 |
|---|---|---|---|
| 495 | 5 | 74614332 | 84706916 |
| 496 | 5 | 74614332 | 84799488 |
| 497 | 5 | 74614332 | 84801081 |
| 498 | 5 | 74614332 | 84824103 |
| 499 | 5 | 74614332 | 84824203 |
| 500 | 5 | 74614332 | 84824816 |
| 501 | 5 | 74614332 | 84825422 |
| 502 | 5 | 74614332 | 84825763 |
| 503 | 5 | 74614332 | 84825942 |
| 504 | 5 | 74614332 | 84936441 |
| 505 | 5 | 74614332 | 84936493 |
| 506 | 5 | 74614332 | 84943705 |
| 507 | 5 | 74614332 | 169454950 |
| 508 | 5 | 74614332 | 181522829 |
| 509 | 5 | 74614332 | 204759879 |
| 510 | 5 | 74614332 | 209874191 |
| 511 | 5 | 77920728 | 78022476 |
| 512 | 5 | 77920728 | 78023096 |
| 513 | 5 | 77920728 | 78131652 |
| 514 | 5 | 77920728 | 78131784 |
| 515 | 5 | 77920728 | 78310499 |
| 516 | 5 | 77920728 | 78381593 |
| 517 | 5 | 77920728 | 78389884 |
| 518 | 5 | 77920728 | 78520683 |
| 519 | 5 | 77920728 | 78765635 |
| 520 | 5 | 77920728 | 78780292 |
| 521 | 5 | 77920728 | 78813114 |
| 522 | 5 | 77920728 | 78814710 |
| 523 | 5 | 77920728 | 78814976 |
| 524 | 5 | 77920728 | 78815306 |
| 525 | 5 | 77920728 | 78821393 |
| 526 | 5 | 77920728 | 78826528 |
| 527 | 5 | 77920728 | 78826538 |
| 528 | 5 | 77920728 | 78826612 |
| 529 | 5 | 77920728 | 78918620 |
| 530 | 5 | 77920728 | 78918850 |
| 531 | 5 | 77920728 | 79056960 |
| 532 | 5 | 77920728 | 79163631 |
| 533 | 5 | 77920728 | 79176557 |
| 534 | 5 | 77920728 | 79188028 |
| 535 | 5 | 77920728 | 79201760 |
| 536 | 5 | 77920728 | 79230005 |
| 537 | 5 | 77920728 | 79230318 |
| 538 | 5 | 77920728 | 79505592 |
| 539 | 5 | 77920728 | 79510072 |
| 540 | 5 | 77920728 | 79538012 |
| 541 | 5 | 77920728 | 79538048 |
| 542 | 5 | 77920728 | 79538367 |
| 543 | 5 | 77920728 | 79669824 |
| 544 | 5 | 77920728 | 79682242 |
| 545 | 5 | 77920728 | 79699261 |
| 546 | 5 | 77920728 | 79710673 |
| 547 | 5 | 77920728 | 79861902 |
| 548 | 5 | 77920728 | 79867710 |
| 549 | 5 | 77920728 | 79867868 |
| 550 | 5 | 77920728 | 79867873 |
| 551 | 5 | 77920728 | 79961961 |
| 552 | 5 | 77920728 | 80086268 |
| 553 | 5 | 77920728 | 80190673 |
| 554 | 5 | 77920728 | 80190777 |
| 555 | 5 | 77920728 | 80192546 |
| 556 | 5 | 77920728 | 80195395 |
| 557 | 5 | 77920728 | 80199923 |
| 558 | 5 | 77920728 | 80241911 |
| 559 | 5 | 77920728 | 80282785 |
| 560 | 5 | 77920728 | 80345337 |
| 561 | 5 | 77920728 | 80389787 |
| 562 | 5 | 77920728 | 80411639 |
| 563 | 5 | 77920728 | 80446855 |
| 564 | 5 | 77920728 | 80492790 |
| 565 | 5 | 77920728 | 80670554 |
| 566 | 5 | 77920728 | 80674679 |
| 567 | 5 | 77920728 | 80720509 |
| 568 | 5 | 77920728 | 80800856 |
| 569 | 5 | 77920728 | 80804587 |
| 570 | 5 | 77920728 | 80807409 |
| 571 | 5 | 77920728 | 80835734 |
| 572 | 5 | 77920728 | 80835734 |
| 573 | 5 | 77920728 | 80971764 |
| 574 | 5 | 77920728 | 80972258 |
| 575 | 5 | 77920728 | 80974450 |
| 576 | 5 | 77920728 | 81047638 |
| 577 | 5 | 77920728 | 81082921 |
| 578 | 5 | 77920728 | 81157909 |
| 579 | 5 | 77920728 | 81265937 |
| 580 | 5 | 77920728 | 81265937 |
| 581 | 5 | 77920728 | 81267485 |
| 582 | 5 | 77920728 | 81267499 |
| 583 | 5 | 77920728 | 81274512 |
| 584 | 5 | 77920728 | 81763618 |
| 585 | 5 | 77920728 | 81797217 |
| 586 | 5 | 77920728 | 81800186 |
| 587 | 5 | 77920728 | 81806213 |
| 588 | 5 | 77920728 | 81854583 |
| 589 | 5 | 77920728 | 81859374 |
| 590 | 5 | 77920728 | 81861368 |
| 591 | 5 | 77920728 | 81863686 |
| 592 | 5 | 77920728 | 81916850 |
| 593 | 5 | 77920728 | 81954891 |
| 594 | 5 | 77920728 | 81985250 |
| 595 | 5 | 77920728 | 82083752 |
| 596 | 5 | 77920728 | 82101253 |
| 597 | 5 | 77920728 | 82143124 |
| 598 | 5 | 77920728 | 82236318 |
| 599 | 5 | 77920728 | 82325587 |
| 600 | 5 | 77920728 | 82427210 |
| 601 | 5 | 77920728 | 82431853 |
| 602 | 5 | 77920728 | 82446714 |
| 603 | 5 | 77920728 | 82446794 |
| 604 | 5 | 77920728 | 82551111 |
| 605 | 5 | 77920728 | 82552090 |
| 606 | 5 | 77920728 | 82555641 |
| 607 | 5 | 77920728 | 82555670 |
| 608 | 5 | 77920728 | 82556511 |
| 609 | 5 | 77920728 | 82559047 |
| 610 | 5 | 77920728 | 82561535 |
| 611 | 5 | 77920728 | 82610100 |
| 612 | 5 | 77920728 | 82676822 |
| 613 | 5 | 77920728 | 82676901 |
| 614 | 5 | 77920728 | 82883691 |
| 615 | 5 | 77920728 | 82954942 |
| 616 | 5 | 77920728 | 82971688 |
| 617 | 5 | 77920728 | 83023965 |
| 618 | 5 | 77920728 | 83094205 |
| 619 | 5 | 77920728 | 83146355 |
| 620 | 5 | 77920728 | 83280630 |
| 621 | 5 | 77920728 | 83281412 |
| 622 | 5 | 77920728 | 83400242 |
| 623 | 5 | 77920728 | 83405797 |
| 624 | 5 | 77920728 | 83437132 |
| 625 | 5 | 77920728 | 83522252 |
| 626 | 5 | 77920728 | 83560095 |
| 627 | 5 | 77920728 | 83560204 |
| 628 | 5 | 77920728 | 83572400 |
| 629 | 5 | 77920728 | 83607661 |
| 630 | 5 | 77920728 | 83745342 |
| 631 | 5 | 77920728 | 83861275 |
| 632 | 5 | 77920728 | 83861633 |
| 633 | 5 | 77920728 | 83865653 |
| 634 | 5 | 77920728 | 83865914 |
| 635 | 5 | 77920728 | 83865920 |
| 636 | 5 | 77920728 | 83868010 |
| 637 | 5 | 77920728 | 84019752 |
| 638 | 5 | 77920728 | 84065912 |
| 639 | 5 | 77920728 | 84086632 |
| 640 | 5 | 77920728 | 84089603 |
| 641 | 5 | 77920728 | 84104814 |
| 642 | 5 | 77920728 | 84105175 |

TABLE 1-continued

Examples of chromosomal segments associated with increased fertility in maize.

| Chromosomal Segment | Chr. | Boundary 1 | Boundary 2 |
|---|---|---|---|
| 643 | 5 | 77920728 | 84251635 |
| 644 | 5 | 77920728 | 84252180 |
| 645 | 5 | 77920728 | 84253030 |
| 646 | 5 | 77920728 | 84254208 |
| 647 | 5 | 77920728 | 84314930 |
| 648 | 5 | 77920728 | 84340523 |
| 649 | 5 | 77920728 | 84516340 |
| 650 | 5 | 77920728 | 84706916 |
| 651 | 5 | 77920728 | 84799488 |
| 652 | 5 | 77920728 | 84801081 |
| 653 | 5 | 77920728 | 84824103 |
| 654 | 5 | 77920728 | 84824103 |
| 655 | 5 | 77920728 | 84824203 |
| 656 | 5 | 77920728 | 84824816 |
| 657 | 5 | 77920728 | 84825422 |
| 658 | 5 | 77920728 | 84825763 |
| 659 | 5 | 77920728 | 84825942 |
| 660 | 5 | 77920728 | 84936441 |
| 661 | 5 | 77920728 | 84936493 |
| 662 | 5 | 77920728 | 84943705 |
| 663 | 5 | 77920728 | 169454950 |
| 664 | 5 | 77920728 | 181522829 |
| 665 | 5 | 77920728 | 204759879 |
| 666 | 5 | 77920728 | 209874191 |
| 667 | 5 | 78022476 | 78023096 |
| 668 | 5 | 78022476 | 78131652 |
| 669 | 5 | 78022476 | 78131784 |
| 670 | 5 | 78022476 | 78310499 |
| 671 | 5 | 78022476 | 78381593 |
| 672 | 5 | 78022476 | 78389884 |
| 673 | 5 | 78022476 | 78520683 |
| 674 | 5 | 78022476 | 78765635 |
| 675 | 5 | 78022476 | 78780292 |
| 676 | 5 | 78022476 | 78813114 |
| 677 | 5 | 78022476 | 78814710 |
| 678 | 5 | 78022476 | 78814976 |
| 679 | 5 | 78022476 | 78815306 |
| 680 | 5 | 78022476 | 78821393 |
| 681 | 5 | 78022476 | 78826528 |
| 682 | 5 | 78022476 | 78826538 |
| 683 | 5 | 78022476 | 78826612 |
| 684 | 5 | 78022476 | 78918620 |
| 685 | 5 | 78022476 | 78918850 |
| 686 | 5 | 78022476 | 79056960 |
| 687 | 5 | 78022476 | 79163631 |
| 688 | 5 | 78022476 | 79176557 |
| 689 | 5 | 78022476 | 79188028 |
| 690 | 5 | 78022476 | 79201760 |
| 691 | 5 | 78022476 | 79230005 |
| 692 | 5 | 78022476 | 79230318 |
| 693 | 5 | 78022476 | 79505592 |
| 694 | 5 | 78022476 | 79510072 |
| 695 | 5 | 78022476 | 79538012 |
| 696 | 5 | 78022476 | 79538048 |
| 697 | 5 | 78022476 | 79538367 |
| 698 | 5 | 78022476 | 79669824 |
| 699 | 5 | 78022476 | 79682242 |
| 700 | 5 | 78022476 | 79699261 |
| 701 | 5 | 78022476 | 79710673 |
| 702 | 5 | 78022476 | 79861902 |
| 703 | 5 | 78022476 | 79867710 |
| 704 | 5 | 78022476 | 79867868 |
| 705 | 5 | 78022476 | 79867873 |
| 706 | 5 | 78022476 | 79961961 |
| 707 | 5 | 78022476 | 80086268 |
| 708 | 5 | 78022476 | 80190673 |
| 709 | 5 | 78022476 | 80190777 |
| 710 | 5 | 78022476 | 80192546 |
| 711 | 5 | 78022476 | 80195395 |
| 712 | 5 | 78022476 | 80199923 |
| 713 | 5 | 78022476 | 80241911 |
| 714 | 5 | 78022476 | 80282785 |
| 715 | 5 | 78022476 | 80345337 |
| 716 | 5 | 78022476 | 80389787 |
| 717 | 5 | 78022476 | 80411639 |
| 718 | 5 | 78022476 | 80446855 |
| 719 | 5 | 78022476 | 80492790 |
| 720 | 5 | 78022476 | 80670554 |
| 721 | 5 | 78022476 | 80674679 |
| 722 | 5 | 78022476 | 80720509 |
| 723 | 5 | 78022476 | 80800856 |
| 724 | 5 | 78022476 | 80804587 |
| 725 | 5 | 78022476 | 80807409 |
| 726 | 5 | 78022476 | 80835734 |
| 727 | 5 | 78022476 | 80835734 |
| 728 | 5 | 78022476 | 80971764 |
| 729 | 5 | 78022476 | 80972258 |
| 730 | 5 | 78022476 | 80974450 |
| 731 | 5 | 78022476 | 81047638 |
| 732 | 5 | 78022476 | 81082921 |
| 733 | 5 | 78022476 | 81157909 |
| 734 | 5 | 78022476 | 81265937 |
| 735 | 5 | 78022476 | 81265937 |
| 736 | 5 | 78022476 | 81267485 |
| 737 | 5 | 78022476 | 81267499 |
| 738 | 5 | 78022476 | 81274512 |
| 739 | 5 | 78022476 | 81763618 |
| 740 | 5 | 78022476 | 81797217 |
| 741 | 5 | 78022476 | 81800186 |
| 742 | 5 | 78022476 | 81806213 |
| 743 | 5 | 78022476 | 81854583 |
| 744 | 5 | 78022476 | 81859374 |
| 745 | 5 | 78022476 | 81861368 |
| 746 | 5 | 78022476 | 81863686 |
| 747 | 5 | 78022476 | 81916850 |
| 748 | 5 | 78022476 | 81954891 |
| 749 | 5 | 78022476 | 81985250 |
| 750 | 5 | 78022476 | 82083752 |
| 751 | 5 | 78022476 | 82101253 |
| 752 | 5 | 78022476 | 82143124 |
| 753 | 5 | 78022476 | 82236318 |
| 754 | 5 | 78022476 | 82325587 |
| 755 | 5 | 78022476 | 82427210 |
| 756 | 5 | 78022476 | 82431853 |
| 757 | 5 | 78022476 | 82446714 |
| 758 | 5 | 78022476 | 82446794 |
| 759 | 5 | 78022476 | 82551111 |
| 760 | 5 | 78022476 | 82552090 |
| 761 | 5 | 78022476 | 82555641 |
| 762 | 5 | 78022476 | 82555670 |
| 763 | 5 | 78022476 | 82556511 |
| 764 | 5 | 78022476 | 82559047 |
| 765 | 5 | 78022476 | 82561535 |
| 766 | 5 | 78022476 | 82610100 |
| 767 | 5 | 78022476 | 82676822 |
| 768 | 5 | 78022476 | 82676901 |
| 769 | 5 | 78022476 | 82883691 |
| 770 | 5 | 78022476 | 82954942 |
| 771 | 5 | 78022476 | 82971688 |
| 772 | 5 | 78022476 | 83023965 |
| 773 | 5 | 78022476 | 83094205 |
| 774 | 5 | 78022476 | 83146355 |
| 775 | 5 | 78022476 | 83280630 |
| 776 | 5 | 78022476 | 83281412 |
| 777 | 5 | 78022476 | 83400242 |
| 778 | 5 | 78022476 | 83405797 |
| 779 | 5 | 78022476 | 83437132 |
| 780 | 5 | 78022476 | 83522252 |
| 781 | 5 | 78022476 | 83560095 |
| 782 | 5 | 78022476 | 83560204 |
| 783 | 5 | 78022476 | 83572400 |
| 784 | 5 | 78022476 | 83607661 |
| 785 | 5 | 78022476 | 83745342 |
| 786 | 5 | 78022476 | 83861275 |
| 787 | 5 | 78022476 | 83861633 |
| 788 | 5 | 78022476 | 83865653 |
| 789 | 5 | 78022476 | 83865914 |
| 790 | 5 | 78022476 | 83865920 |

TABLE 1-continued

Examples of chromosomal segments associated with increased fertility in maize.

| Chromosomal Segment | Chr. | Boundary 1 | Boundary 2 |
|---|---|---|---|
| 791 | 5 | 78022476 | 83868010 |
| 792 | 5 | 78022476 | 84019752 |
| 793 | 5 | 78022476 | 84065912 |
| 794 | 5 | 78022476 | 84086632 |
| 795 | 5 | 78022476 | 84089603 |
| 796 | 5 | 78022476 | 84104814 |
| 797 | 5 | 78022476 | 84105175 |
| 798 | 5 | 78022476 | 84251635 |
| 799 | 5 | 78022476 | 84252180 |
| 800 | 5 | 78022476 | 84253030 |
| 801 | 5 | 78022476 | 84254208 |
| 802 | 5 | 78022476 | 84314930 |
| 803 | 5 | 78022476 | 84340523 |
| 804 | 5 | 78022476 | 84516340 |
| 805 | 5 | 78022476 | 84706916 |
| 806 | 5 | 78022476 | 84799488 |
| 807 | 5 | 78022476 | 84801081 |
| 808 | 5 | 78022476 | 84824103 |
| 809 | 5 | 78022476 | 84824203 |
| 810 | 5 | 78022476 | 84824816 |
| 811 | 5 | 78022476 | 84825422 |
| 812 | 5 | 78022476 | 84825763 |
| 813 | 5 | 78022476 | 84825942 |
| 814 | 5 | 78022476 | 84936441 |
| 815 | 5 | 78022476 | 84936493 |
| 816 | 5 | 78022476 | 84943705 |
| 817 | 5 | 78022476 | 169454950 |
| 818 | 5 | 78022476 | 181522829 |
| 819 | 5 | 78022476 | 204759879 |
| 820 | 5 | 78022476 | 209874191 |
| 821 | 5 | 78129898 | 78131652 |
| 822 | 5 | 78129898 | 78131784 |
| 823 | 5 | 78129898 | 78310499 |
| 824 | 5 | 78129898 | 78381593 |
| 825 | 5 | 78129898 | 78389884 |
| 826 | 5 | 78129898 | 78520683 |
| 827 | 5 | 78129898 | 78765635 |
| 828 | 5 | 78129898 | 78780292 |
| 829 | 5 | 78129898 | 78813114 |
| 830 | 5 | 78129898 | 78814710 |
| 831 | 5 | 78129898 | 78814976 |
| 832 | 5 | 78129898 | 78815306 |
| 833 | 5 | 78129898 | 78821393 |
| 834 | 5 | 78129898 | 78826528 |
| 835 | 5 | 78129898 | 78826538 |
| 836 | 5 | 78129898 | 78826612 |
| 837 | 5 | 78129898 | 78918620 |
| 838 | 5 | 78129898 | 78918850 |
| 839 | 5 | 78129898 | 79056960 |
| 840 | 5 | 78129898 | 79163631 |
| 841 | 5 | 78129898 | 79176557 |
| 842 | 5 | 78129898 | 79188028 |
| 843 | 5 | 78129898 | 79201760 |
| 844 | 5 | 78129898 | 79230005 |
| 845 | 5 | 78129898 | 79230318 |
| 846 | 5 | 78129898 | 79505592 |
| 847 | 5 | 78129898 | 79510072 |
| 848 | 5 | 78129898 | 79538012 |
| 849 | 5 | 78129898 | 79538048 |
| 850 | 5 | 78129898 | 79538367 |
| 851 | 5 | 78129898 | 79669824 |
| 852 | 5 | 78129898 | 79682242 |
| 853 | 5 | 78129898 | 79699261 |
| 854 | 5 | 78129898 | 79710673 |
| 855 | 5 | 78129898 | 79861902 |
| 856 | 5 | 78129898 | 79867710 |
| 857 | 5 | 78129898 | 79867868 |
| 858 | 5 | 78129898 | 79867873 |
| 859 | 5 | 78129898 | 79961961 |
| 860 | 5 | 78129898 | 80086268 |
| 861 | 5 | 78129898 | 80190673 |
| 862 | 5 | 78129898 | 80190777 |
| 863 | 5 | 78129898 | 80192546 |
| 864 | 5 | 78129898 | 80195395 |
| 865 | 5 | 78129898 | 80199923 |
| 866 | 5 | 78129898 | 80241911 |
| 867 | 5 | 78129898 | 80282785 |
| 868 | 5 | 78129898 | 80345337 |
| 869 | 5 | 78129898 | 80389787 |
| 870 | 5 | 78129898 | 80411639 |
| 871 | 5 | 78129898 | 80446855 |
| 872 | 5 | 78129898 | 80492790 |
| 873 | 5 | 78129898 | 80670554 |
| 874 | 5 | 78129898 | 80674679 |
| 875 | 5 | 78129898 | 80720509 |
| 876 | 5 | 78129898 | 80800856 |
| 877 | 5 | 78129898 | 80804587 |
| 878 | 5 | 78129898 | 80807409 |
| 879 | 5 | 78129898 | 80835734 |
| 880 | 5 | 78129898 | 80971764 |
| 881 | 5 | 78129898 | 80972258 |
| 882 | 5 | 78129898 | 80974450 |
| 883 | 5 | 78129898 | 81047638 |
| 884 | 5 | 78129898 | 81082921 |
| 885 | 5 | 78129898 | 81157909 |
| 886 | 5 | 78129898 | 81265937 |
| 887 | 5 | 78129898 | 81265937 |
| 888 | 5 | 78129898 | 81267485 |
| 889 | 5 | 78129898 | 81267499 |
| 890 | 5 | 78129898 | 81274512 |
| 891 | 5 | 78129898 | 81763618 |
| 892 | 5 | 78129898 | 81797217 |
| 893 | 5 | 78129898 | 81800186 |
| 894 | 5 | 78129898 | 81806213 |
| 895 | 5 | 78129898 | 81854583 |
| 896 | 5 | 78129898 | 81859374 |
| 897 | 5 | 78129898 | 81861368 |
| 898 | 5 | 78129898 | 81863686 |
| 899 | 5 | 78129898 | 81916850 |
| 900 | 5 | 78129898 | 81954891 |
| 901 | 5 | 78129898 | 81985250 |
| 902 | 5 | 78129898 | 82083752 |
| 903 | 5 | 78129898 | 82101253 |
| 904 | 5 | 78129898 | 82143124 |
| 905 | 5 | 78129898 | 82236318 |
| 906 | 5 | 78129898 | 82325587 |
| 907 | 5 | 78129898 | 82427210 |
| 908 | 5 | 78129898 | 82431853 |
| 909 | 5 | 78129898 | 82446714 |
| 910 | 5 | 78129898 | 82446794 |
| 911 | 5 | 78129898 | 82551111 |
| 912 | 5 | 78129898 | 82552090 |
| 913 | 5 | 78129898 | 82555670 |
| 914 | 5 | 78129898 | 82555670 |
| 915 | 5 | 78129898 | 82556511 |
| 916 | 5 | 78129898 | 82559047 |
| 917 | 5 | 78129898 | 82561535 |
| 918 | 5 | 78129898 | 82610100 |
| 919 | 5 | 78129898 | 82676822 |
| 920 | 5 | 78129898 | 82676901 |
| 921 | 5 | 78129898 | 82883691 |
| 922 | 5 | 78129898 | 82954942 |
| 923 | 5 | 78129898 | 82971688 |
| 924 | 5 | 78129898 | 83023965 |
| 925 | 5 | 78129898 | 83094205 |
| 926 | 5 | 78129898 | 83146355 |
| 927 | 5 | 78129898 | 83280630 |
| 928 | 5 | 78129898 | 83281412 |
| 929 | 5 | 78129898 | 83400242 |
| 930 | 5 | 78129898 | 83405797 |
| 931 | 5 | 78129898 | 83437132 |
| 932 | 5 | 78129898 | 83522252 |
| 933 | 5 | 78129898 | 83560095 |
| 934 | 5 | 78129898 | 83560204 |
| 935 | 5 | 78129898 | 83572400 |
| 936 | 5 | 78129898 | 83607661 |
| 937 | 5 | 78129898 | 83745342 |
| 938 | 5 | 78129898 | 83861275 |

TABLE 1-continued

Examples of chromosomal segments associated with increased fertility in maize.

| Chromosomal Segment | Chr. | Boundary 1 | Boundary 2 |
|---|---|---|---|
| 939 | 5 | 78129898 | 83861633 |
| 940 | 5 | 78129898 | 83865653 |
| 941 | 5 | 78129898 | 83865914 |
| 942 | 5 | 78129898 | 83865920 |
| 943 | 5 | 78129898 | 83868010 |
| 944 | 5 | 78129898 | 84019752 |
| 945 | 5 | 78129898 | 84065912 |
| 946 | 5 | 78129898 | 84086632 |
| 947 | 5 | 78129898 | 84089603 |
| 948 | 5 | 78129898 | 84104814 |
| 949 | 5 | 78129898 | 84105175 |
| 950 | 5 | 78129898 | 84251635 |
| 951 | 5 | 78129898 | 84252180 |
| 952 | 5 | 78129898 | 84253030 |
| 953 | 5 | 78129898 | 84254208 |
| 954 | 5 | 78129898 | 84314930 |
| 955 | 5 | 78129898 | 84340523 |
| 956 | 5 | 78129898 | 84516340 |
| 957 | 5 | 78129898 | 84706916 |
| 958 | 5 | 78129898 | 84799488 |
| 959 | 5 | 78129898 | 84801081 |
| 960 | 5 | 78129898 | 84824103 |
| 961 | 5 | 78129898 | 84824203 |
| 962 | 5 | 78129898 | 84824816 |
| 963 | 5 | 78129898 | 84825422 |
| 964 | 5 | 78129898 | 84825763 |
| 965 | 5 | 78129898 | 84825942 |
| 966 | 5 | 78129898 | 84843411 |
| 967 | 5 | 78129898 | 84936441 |
| 968 | 5 | 78129898 | 84936493 |
| 969 | 5 | 78129898 | 84943705 |
| 970 | 5 | 78129898 | 169454950 |
| 971 | 5 | 78129898 | 181522829 |
| 972 | 5 | 78129898 | 204759879 |
| 973 | 5 | 78129898 | 209874191 |
| 974 | 5 | 78255163 | 78310499 |
| 975 | 5 | 78255163 | 78381593 |
| 976 | 5 | 78255163 | 78389884 |
| 977 | 5 | 78255163 | 78520683 |
| 978 | 5 | 78255163 | 78765635 |
| 979 | 5 | 78255163 | 78780292 |
| 980 | 5 | 78255163 | 78813114 |
| 981 | 5 | 78255163 | 78814710 |
| 982 | 5 | 78255163 | 78814976 |
| 983 | 5 | 78255163 | 78815306 |
| 984 | 5 | 78255163 | 78821393 |
| 985 | 5 | 78255163 | 78826528 |
| 986 | 5 | 78255163 | 78826538 |
| 987 | 5 | 78255163 | 78826612 |
| 988 | 5 | 78255163 | 78918620 |
| 989 | 5 | 78255163 | 78918850 |
| 990 | 5 | 78255163 | 79056960 |
| 991 | 5 | 78255163 | 79163631 |
| 992 | 5 | 78255163 | 79176557 |
| 993 | 5 | 78255163 | 79188028 |
| 994 | 5 | 78255163 | 79201760 |
| 995 | 5 | 78255163 | 79230005 |
| 996 | 5 | 78255163 | 79230318 |
| 997 | 5 | 78255163 | 79505592 |
| 998 | 5 | 78255163 | 79510072 |
| 999 | 5 | 78255163 | 79538012 |
| 1000 | 5 | 78255163 | 79538048 |
| 1001 | 5 | 78255163 | 79538367 |
| 1002 | 5 | 78255163 | 79669824 |
| 1003 | 5 | 78255163 | 79682242 |
| 1004 | 5 | 78255163 | 79699261 |
| 1005 | 5 | 78255163 | 79710673 |
| 1006 | 5 | 78255163 | 79861902 |
| 1007 | 5 | 78255163 | 79867710 |
| 1008 | 5 | 78255163 | 79867868 |
| 1009 | 5 | 78255163 | 79867873 |
| 1010 | 5 | 78255163 | 79961961 |
| 1011 | 5 | 78255163 | 80086268 |
| 1012 | 5 | 78255163 | 80190673 |
| 1013 | 5 | 78255163 | 80190777 |
| 1014 | 5 | 78255163 | 80192546 |
| 1015 | 5 | 78255163 | 80195395 |
| 1016 | 5 | 78255163 | 80199923 |
| 1017 | 5 | 78255163 | 80241911 |
| 1018 | 5 | 78255163 | 80282785 |
| 1019 | 5 | 78255163 | 80345337 |
| 1020 | 5 | 78255163 | 80389787 |
| 1021 | 5 | 78255163 | 80411639 |
| 1022 | 5 | 78255163 | 80446855 |
| 1023 | 5 | 78255163 | 80492790 |
| 1024 | 5 | 78255163 | 80670554 |
| 1025 | 5 | 78255163 | 80674679 |
| 1026 | 5 | 78255163 | 80720509 |
| 1027 | 5 | 78255163 | 80800856 |
| 1028 | 5 | 78255163 | 80804587 |
| 1029 | 5 | 78255163 | 80807409 |
| 1030 | 5 | 78255163 | 80835734 |
| 1031 | 5 | 78255163 | 80971764 |
| 1032 | 5 | 78255163 | 80972258 |
| 1033 | 5 | 78255163 | 80974450 |
| 1034 | 5 | 78255163 | 81047638 |
| 1035 | 5 | 78255163 | 81082921 |
| 1036 | 5 | 78255163 | 81157909 |
| 1037 | 5 | 78255163 | 81265937 |
| 1038 | 5 | 78255163 | 81265937 |
| 1039 | 5 | 78255163 | 81267485 |
| 1040 | 5 | 78255163 | 81267499 |
| 1041 | 5 | 78255163 | 81274512 |
| 1042 | 5 | 78255163 | 81763618 |
| 1043 | 5 | 78255163 | 81797217 |
| 1044 | 5 | 78255163 | 81800186 |
| 1045 | 5 | 78255163 | 81806213 |
| 1046 | 5 | 78255163 | 81854583 |
| 1047 | 5 | 78255163 | 81859374 |
| 1048 | 5 | 78255163 | 81861368 |
| 1049 | 5 | 78255163 | 81863686 |
| 1050 | 5 | 78255163 | 81916850 |
| 1051 | 5 | 78255163 | 81954891 |
| 1052 | 5 | 78255163 | 81985250 |
| 1053 | 5 | 78255163 | 82083752 |
| 1054 | 5 | 78255163 | 82101253 |
| 1055 | 5 | 78255163 | 82143124 |
| 1056 | 5 | 78255163 | 82236318 |
| 1057 | 5 | 78255163 | 82325587 |
| 1058 | 5 | 78255163 | 82427210 |
| 1059 | 5 | 78255163 | 82431853 |
| 1060 | 5 | 78255163 | 82446714 |
| 1061 | 5 | 78255163 | 82446794 |
| 1062 | 5 | 78255163 | 82551111 |
| 1063 | 5 | 78255163 | 82552090 |
| 1064 | 5 | 78255163 | 82555641 |
| 1065 | 5 | 78255163 | 82555670 |
| 1066 | 5 | 78255163 | 82556511 |
| 1067 | 5 | 78255163 | 82559047 |
| 1068 | 5 | 78255163 | 82561535 |
| 1069 | 5 | 78255163 | 82610100 |
| 1070 | 5 | 78255163 | 82676822 |
| 1071 | 5 | 78255163 | 82676901 |
| 1072 | 5 | 78255163 | 82883691 |
| 1073 | 5 | 78255163 | 82954942 |
| 1074 | 5 | 78255163 | 82971688 |
| 1075 | 5 | 78255163 | 83023965 |
| 1076 | 5 | 78255163 | 83094205 |
| 1077 | 5 | 78255163 | 83146355 |
| 1078 | 5 | 78255163 | 83280630 |
| 1079 | 5 | 78255163 | 83281412 |
| 1080 | 5 | 78255163 | 83400242 |
| 1081 | 5 | 78255163 | 83405797 |
| 1082 | 5 | 78255163 | 83437132 |
| 1083 | 5 | 78255163 | 83522252 |
| 1084 | 5 | 78255163 | 83560095 |
| 1085 | 5 | 78255163 | 83560204 |
| 1086 | 5 | 78255163 | 83572400 |

TABLE 1-continued

Examples of chromosomal segments associated with increased fertility in maize.

| Chromosomal Segment | Chr. | Boundary 1 | Boundary 2 |
| --- | --- | --- | --- |
| 1087 | 5 | 78255163 | 83607661 |
| 1088 | 5 | 78255163 | 83745342 |
| 1089 | 5 | 78255163 | 83861275 |
| 1090 | 5 | 78255163 | 83861633 |
| 1091 | 5 | 78255163 | 83865653 |
| 1092 | 5 | 78255163 | 83865914 |
| 1093 | 5 | 78255163 | 83865920 |
| 1094 | 5 | 78255163 | 83868010 |
| 1095 | 5 | 78255163 | 84019752 |
| 1096 | 5 | 78255163 | 84065912 |
| 1097 | 5 | 78255163 | 84086632 |
| 1098 | 5 | 78255163 | 84089603 |
| 1099 | 5 | 78255163 | 84104814 |
| 1100 | 5 | 78255163 | 84105175 |
| 1101 | 5 | 78255163 | 84251635 |
| 1102 | 5 | 78255163 | 84252180 |
| 1103 | 5 | 78255163 | 84253030 |
| 1104 | 5 | 78255163 | 84254208 |
| 1105 | 5 | 78255163 | 84314930 |
| 1106 | 5 | 78255163 | 84340523 |
| 1107 | 5 | 78255163 | 84516340 |
| 1108 | 5 | 78255163 | 84706916 |
| 1109 | 5 | 78255163 | 84799488 |
| 1110 | 5 | 78255163 | 84801081 |
| 1111 | 5 | 78255163 | 84824103 |
| 1112 | 5 | 78255163 | 84824203 |
| 1113 | 5 | 78255163 | 84824816 |
| 1114 | 5 | 78255163 | 84825422 |
| 1115 | 5 | 78255163 | 84825763 |
| 1116 | 5 | 78255163 | 84825942 |
| 1117 | 5 | 78255163 | 84843411 |
| 1118 | 5 | 78255163 | 84936441 |
| 1119 | 5 | 78255163 | 84936493 |
| 1120 | 5 | 78255163 | 84943705 |
| 1121 | 5 | 78255163 | 169454950 |
| 1122 | 5 | 78255163 | 181522829 |
| 1123 | 5 | 78255163 | 204759879 |
| 1124 | 5 | 78255163 | 209874191 |
| 1125 | 5 | 78380304 | 78381593 |
| 1126 | 5 | 78380304 | 78389884 |
| 1127 | 5 | 78380304 | 78520683 |
| 1128 | 5 | 78380304 | 78765635 |
| 1129 | 5 | 78380304 | 78780292 |
| 1130 | 5 | 78380304 | 78813114 |
| 1131 | 5 | 78380304 | 78814710 |
| 1132 | 5 | 78380304 | 78814976 |
| 1133 | 5 | 78380304 | 78815306 |
| 1134 | 5 | 78380304 | 78821393 |
| 1135 | 5 | 78380304 | 78826528 |
| 1136 | 5 | 78380304 | 78826538 |
| 1137 | 5 | 78380304 | 78826612 |
| 1138 | 5 | 78380304 | 78918620 |
| 1139 | 5 | 78380304 | 78918850 |
| 1140 | 5 | 78380304 | 79056960 |
| 1141 | 5 | 78380304 | 79163631 |
| 1142 | 5 | 78380304 | 79176557 |
| 1143 | 5 | 78380304 | 79188028 |
| 1144 | 5 | 78380304 | 79201760 |
| 1145 | 5 | 78380304 | 79230005 |
| 1146 | 5 | 78380304 | 79230318 |
| 1147 | 5 | 78380304 | 79505592 |
| 1148 | 5 | 78380304 | 79510072 |
| 1149 | 5 | 78380304 | 79538012 |
| 1150 | 5 | 78380304 | 79538048 |
| 1151 | 5 | 78380304 | 79538048 |
| 1152 | 5 | 78380304 | 79538367 |
| 1153 | 5 | 78380304 | 79669824 |
| 1154 | 5 | 78380304 | 79682242 |
| 1155 | 5 | 78380304 | 79699261 |
| 1156 | 5 | 78380304 | 79710673 |
| 1157 | 5 | 78380304 | 79861902 |
| 1158 | 5 | 78380304 | 79867710 |
| 1159 | 5 | 78380304 | 79867868 |
| 1160 | 5 | 78380304 | 79867873 |
| 1161 | 5 | 78380304 | 79961961 |
| 1162 | 5 | 78380304 | 80086268 |
| 1163 | 5 | 78380304 | 80190673 |
| 1164 | 5 | 78380304 | 80190777 |
| 1165 | 5 | 78380304 | 80192546 |
| 1166 | 5 | 78380304 | 80195395 |
| 1167 | 5 | 78380304 | 80199923 |
| 1168 | 5 | 78380304 | 80241911 |
| 1169 | 5 | 78380304 | 80282785 |
| 1170 | 5 | 78380304 | 80345337 |
| 1171 | 5 | 78380304 | 80389787 |
| 1172 | 5 | 78380304 | 80411639 |
| 1173 | 5 | 78380304 | 80446855 |
| 1174 | 5 | 78380304 | 80492790 |
| 1175 | 5 | 78380304 | 80670554 |
| 1176 | 5 | 78380304 | 80674679 |
| 1177 | 5 | 78380304 | 80720509 |
| 1178 | 5 | 78380304 | 80800856 |
| 1179 | 5 | 78380304 | 80804587 |
| 1180 | 5 | 78380304 | 80807409 |
| 1181 | 5 | 78380304 | 80835734 |
| 1182 | 5 | 78380304 | 80971764 |
| 1183 | 5 | 78380304 | 80972258 |
| 1184 | 5 | 78380304 | 80974450 |
| 1185 | 5 | 78380304 | 81047638 |
| 1186 | 5 | 78380304 | 81082921 |
| 1187 | 5 | 78380304 | 81157909 |
| 1188 | 5 | 78380304 | 81265937 |
| 1189 | 5 | 78380304 | 81265937 |
| 1190 | 5 | 78380304 | 81267485 |
| 1191 | 5 | 78380304 | 81267499 |
| 1192 | 5 | 78380304 | 81274512 |
| 1193 | 5 | 78380304 | 81763618 |
| 1194 | 5 | 78380304 | 81797217 |
| 1195 | 5 | 78380304 | 81800186 |
| 1196 | 5 | 78380304 | 81806213 |
| 1197 | 5 | 78380304 | 81854583 |
| 1198 | 5 | 78380304 | 81859374 |
| 1199 | 5 | 78380304 | 81861368 |
| 1200 | 5 | 78380304 | 81863686 |
| 1201 | 5 | 78380304 | 81916850 |
| 1202 | 5 | 78380304 | 81954891 |
| 1203 | 5 | 78380304 | 81985250 |
| 1204 | 5 | 78380304 | 82083752 |
| 1205 | 5 | 78380304 | 82101253 |
| 1206 | 5 | 78380304 | 82143124 |
| 1207 | 5 | 78380304 | 82236318 |
| 1208 | 5 | 78380304 | 82325587 |
| 1209 | 5 | 78380304 | 82427210 |
| 1210 | 5 | 78380304 | 82431853 |
| 1211 | 5 | 78380304 | 82446714 |
| 1212 | 5 | 78380304 | 82446794 |
| 1213 | 5 | 78380304 | 82551111 |
| 1214 | 5 | 78380304 | 82552090 |
| 1215 | 5 | 78380304 | 82555641 |
| 1216 | 5 | 78380304 | 82555670 |
| 1217 | 5 | 78380304 | 82556511 |
| 1218 | 5 | 78380304 | 82559047 |
| 1219 | 5 | 78380304 | 82561535 |
| 1220 | 5 | 78380304 | 82610100 |
| 1221 | 5 | 78380304 | 82676822 |
| 1222 | 5 | 78380304 | 82676901 |
| 1223 | 5 | 78380304 | 82883691 |
| 1224 | 5 | 78380304 | 82954942 |
| 1225 | 5 | 78380304 | 82971688 |
| 1226 | 5 | 78380304 | 83023965 |
| 1227 | 5 | 78380304 | 83094205 |
| 1228 | 5 | 78380304 | 83146355 |
| 1229 | 5 | 78380304 | 83280630 |
| 1230 | 5 | 78380304 | 83281412 |
| 1231 | 5 | 78380304 | 83400242 |
| 1232 | 5 | 78380304 | 83405797 |
| 1233 | 5 | 78380304 | 83437132 |
| 1234 | 5 | 78380304 | 83522252 |

TABLE 1-continued

Examples of chromosomal segments associated with increased fertility in maize.

| Chromosomal Segment | Chr. | Boundary 1 | Boundary 2 |
|---|---|---|---|
| 1235 | 5 | 78380304 | 83560095 |
| 1236 | 5 | 78380304 | 83560204 |
| 1237 | 5 | 78380304 | 83572400 |
| 1238 | 5 | 78380304 | 83607661 |
| 1239 | 5 | 78380304 | 83745342 |
| 1240 | 5 | 78380304 | 83861275 |
| 1241 | 5 | 78380304 | 83861633 |
| 1242 | 5 | 78380304 | 83865653 |
| 1243 | 5 | 78380304 | 83865914 |
| 1244 | 5 | 78380304 | 83865920 |
| 1245 | 5 | 78380304 | 83868010 |
| 1246 | 5 | 78380304 | 84019752 |
| 1247 | 5 | 78380304 | 84065912 |
| 1248 | 5 | 78380304 | 84086632 |
| 1249 | 5 | 78380304 | 84089603 |
| 1250 | 5 | 78380304 | 84104814 |
| 1251 | 5 | 78380304 | 84105175 |
| 1252 | 5 | 78380304 | 84251635 |
| 1253 | 5 | 78380304 | 84252180 |
| 1254 | 5 | 78380304 | 84253030 |
| 1255 | 5 | 78380304 | 84254208 |
| 1256 | 5 | 78380304 | 84314930 |
| 1257 | 5 | 78380304 | 84340523 |
| 1258 | 5 | 78380304 | 84516340 |
| 1259 | 5 | 78380304 | 84706916 |
| 1260 | 5 | 78380304 | 84799488 |
| 1261 | 5 | 78380304 | 84801081 |
| 1262 | 5 | 78380304 | 84824103 |
| 1263 | 5 | 78380304 | 84824203 |
| 1264 | 5 | 78380304 | 84824816 |
| 1265 | 5 | 78380304 | 84825422 |
| 1266 | 5 | 78380304 | 84825763 |
| 1267 | 5 | 78380304 | 84825942 |
| 1268 | 5 | 78380304 | 84843411 |
| 1269 | 5 | 78380304 | 84936441 |
| 1270 | 5 | 78380304 | 84936493 |
| 1271 | 5 | 78380304 | 84943705 |
| 1272 | 5 | 78380304 | 169454950 |
| 1273 | 5 | 78380304 | 181522829 |
| 1274 | 5 | 78380304 | 204759879 |
| 1275 | 5 | 78380304 | 209874191 |
| 1276 | 5 | 78381834 | 78389884 |
| 1277 | 5 | 78381834 | 78520683 |
| 1278 | 5 | 78381834 | 78765635 |
| 1279 | 5 | 78381834 | 78780292 |
| 1280 | 5 | 78381834 | 78813114 |
| 1281 | 5 | 78381834 | 78814710 |
| 1282 | 5 | 78381834 | 78814976 |
| 1283 | 5 | 78381834 | 78815306 |
| 1284 | 5 | 78381834 | 78821393 |
| 1285 | 5 | 78381834 | 78826528 |
| 1286 | 5 | 78381834 | 78826538 |
| 1287 | 5 | 78381834 | 78826612 |
| 1288 | 5 | 78381834 | 78918620 |
| 1289 | 5 | 78381834 | 78918850 |
| 1290 | 5 | 78381834 | 79056960 |
| 1291 | 5 | 78381834 | 79163631 |
| 1292 | 5 | 78381834 | 79176557 |
| 1293 | 5 | 78381834 | 79188028 |
| 1294 | 5 | 78381834 | 79201760 |
| 1295 | 5 | 78381834 | 79230005 |
| 1296 | 5 | 78381834 | 79230318 |
| 1297 | 5 | 78381834 | 79505592 |
| 1298 | 5 | 78381834 | 79510072 |
| 1299 | 5 | 78381834 | 79538012 |
| 1300 | 5 | 78381834 | 79538048 |
| 1301 | 5 | 78381834 | 79538367 |
| 1302 | 5 | 78381834 | 79669824 |
| 1303 | 5 | 78381834 | 79682242 |
| 1304 | 5 | 78381834 | 79699261 |
| 1305 | 5 | 78381834 | 79710673 |
| 1306 | 5 | 78381834 | 79861902 |
| 1307 | 5 | 78381834 | 79867710 |
| 1308 | 5 | 78381834 | 79867868 |
| 1309 | 5 | 78381834 | 79867873 |
| 1310 | 5 | 78381834 | 79961961 |
| 1311 | 5 | 78381834 | 80086268 |
| 1312 | 5 | 78381834 | 80190673 |
| 1313 | 5 | 78381834 | 80190777 |
| 1314 | 5 | 78381834 | 80192546 |
| 1315 | 5 | 78381834 | 80195395 |
| 1316 | 5 | 78381834 | 80199923 |
| 1317 | 5 | 78381834 | 80241911 |
| 1318 | 5 | 78381834 | 80282785 |
| 1319 | 5 | 78381834 | 80345337 |
| 1320 | 5 | 78381834 | 80389787 |
| 1321 | 5 | 78381834 | 80411639 |
| 1322 | 5 | 78381834 | 80446855 |
| 1323 | 5 | 78381834 | 80492790 |
| 1324 | 5 | 78381834 | 80670554 |
| 1325 | 5 | 78381834 | 80674679 |
| 1326 | 5 | 78381834 | 80720509 |
| 1327 | 5 | 78381834 | 80800856 |
| 1328 | 5 | 78381834 | 80804587 |
| 1329 | 5 | 78381834 | 80807409 |
| 1330 | 5 | 78381834 | 80835734 |
| 1331 | 5 | 78381834 | 80971764 |
| 1332 | 5 | 78381834 | 80972258 |
| 1333 | 5 | 78381834 | 80974450 |
| 1334 | 5 | 78381834 | 81047638 |
| 1335 | 5 | 78381834 | 81082921 |
| 1336 | 5 | 78381834 | 81157909 |
| 1337 | 5 | 78381834 | 81265937 |
| 1338 | 5 | 78381834 | 81265937 |
| 1339 | 5 | 78381834 | 81267485 |
| 1340 | 5 | 78381834 | 81267499 |
| 1341 | 5 | 78381834 | 81274512 |
| 1342 | 5 | 78381834 | 81763618 |
| 1343 | 5 | 78381834 | 81797217 |
| 1344 | 5 | 78381834 | 81800186 |
| 1345 | 5 | 78381834 | 81806213 |
| 1346 | 5 | 78381834 | 81854583 |
| 1347 | 5 | 78381834 | 81859374 |
| 1348 | 5 | 78381834 | 81861368 |
| 1349 | 5 | 78381834 | 81863686 |
| 1350 | 5 | 78381834 | 81916850 |
| 1351 | 5 | 78381834 | 81954891 |
| 1352 | 5 | 78381834 | 81985250 |
| 1353 | 5 | 78381834 | 82083752 |
| 1354 | 5 | 78381834 | 82101253 |
| 1355 | 5 | 78381834 | 82143124 |
| 1356 | 5 | 78381834 | 82236318 |
| 1357 | 5 | 78381834 | 82325587 |
| 1358 | 5 | 78381834 | 82427210 |
| 1359 | 5 | 78381834 | 82431853 |
| 1360 | 5 | 78381834 | 82446714 |
| 1361 | 5 | 78381834 | 82446794 |
| 1362 | 5 | 78381834 | 82551111 |
| 1363 | 5 | 78381834 | 82552090 |
| 1364 | 5 | 78381834 | 82555641 |
| 1365 | 5 | 78381834 | 82555670 |
| 1366 | 5 | 78381834 | 82556511 |
| 1367 | 5 | 78381834 | 82559047 |
| 1368 | 5 | 78381834 | 82561535 |
| 1369 | 5 | 78381834 | 82610100 |
| 1370 | 5 | 78381834 | 82676822 |
| 1371 | 5 | 78381834 | 82676901 |
| 1372 | 5 | 78381834 | 82883691 |
| 1373 | 5 | 78381834 | 82954942 |
| 1374 | 5 | 78381834 | 82971688 |
| 1375 | 5 | 78381834 | 83023965 |
| 1376 | 5 | 78381834 | 83094205 |
| 1377 | 5 | 78381834 | 83146355 |
| 1378 | 5 | 78381834 | 83280630 |
| 1379 | 5 | 78381834 | 83281412 |
| 1380 | 5 | 78381834 | 83400242 |
| 1381 | 5 | 78381834 | 83405797 |
| 1382 | 5 | 78381834 | 83437132 |

TABLE 1-continued

Examples of chromosomal segments associated with increased fertility in maize.

| Chromosomal Segment | Chr. | Boundary 1 | Boundary 2 |
|---|---|---|---|
| 1383 | 5 | 78381834 | 83522252 |
| 1384 | 5 | 78381834 | 83560095 |
| 1385 | 5 | 78381834 | 83560204 |
| 1386 | 5 | 78381834 | 83572400 |
| 1387 | 5 | 78381834 | 83607661 |
| 1388 | 5 | 78381834 | 83745342 |
| 1389 | 5 | 78381834 | 83861275 |
| 1390 | 5 | 78381834 | 83861633 |
| 1391 | 5 | 78381834 | 83865653 |
| 1392 | 5 | 78381834 | 83865914 |
| 1393 | 5 | 78381834 | 83865920 |
| 1394 | 5 | 78381834 | 83868010 |
| 1395 | 5 | 78381834 | 84019752 |
| 1396 | 5 | 78381834 | 84065912 |
| 1397 | 5 | 78381834 | 84086632 |
| 1398 | 5 | 78381834 | 84089603 |
| 1399 | 5 | 78381834 | 84104814 |
| 1400 | 5 | 78381834 | 84105175 |
| 1401 | 5 | 78381834 | 84251635 |
| 1402 | 5 | 78381834 | 84252180 |
| 1403 | 5 | 78381834 | 84253030 |
| 1404 | 5 | 78381834 | 84254208 |
| 1405 | 5 | 78381834 | 84314930 |
| 1406 | 5 | 78381834 | 84340523 |
| 1407 | 5 | 78381834 | 84516340 |
| 1408 | 5 | 78381834 | 84706916 |
| 1409 | 5 | 78381834 | 84799488 |
| 1410 | 5 | 78381834 | 84801081 |
| 1411 | 5 | 78381834 | 84824103 |
| 1412 | 5 | 78381834 | 84824203 |
| 1413 | 5 | 78381834 | 84824816 |
| 1414 | 5 | 78381834 | 84825422 |
| 1415 | 5 | 78381834 | 84825763 |
| 1416 | 5 | 78381834 | 84825942 |
| 1417 | 5 | 78381834 | 84843411 |
| 1418 | 5 | 78381834 | 84936441 |
| 1419 | 5 | 78381834 | 84936493 |
| 1420 | 5 | 78381834 | 84943705 |
| 1421 | 5 | 78381834 | 169454950 |
| 1422 | 5 | 78381834 | 181522829 |
| 1423 | 5 | 78381834 | 204759879 |
| 1424 | 5 | 78381834 | 209874191 |
| 1425 | 5 | 78519893 | 78520683 |
| 1426 | 5 | 78519893 | 78765635 |
| 1427 | 5 | 78519893 | 78780292 |
| 1428 | 5 | 78519893 | 78813114 |
| 1429 | 5 | 78519893 | 78814710 |
| 1430 | 5 | 78519893 | 78814976 |
| 1431 | 5 | 78519893 | 78815306 |
| 1432 | 5 | 78519893 | 78821393 |
| 1433 | 5 | 78519893 | 78826528 |
| 1434 | 5 | 78519893 | 78826538 |
| 1435 | 5 | 78519893 | 78826612 |
| 1436 | 5 | 78519893 | 78918620 |
| 1437 | 5 | 78519893 | 78918850 |
| 1438 | 5 | 78519893 | 79056960 |
| 1439 | 5 | 78519893 | 79163631 |
| 1440 | 5 | 78519893 | 79176557 |
| 1441 | 5 | 78519893 | 79188028 |
| 1442 | 5 | 78519893 | 79201760 |
| 1443 | 5 | 78519893 | 79230005 |
| 1444 | 5 | 78519893 | 79230318 |
| 1445 | 5 | 78519893 | 79505592 |
| 1446 | 5 | 78519893 | 79510072 |
| 1447 | 5 | 78519893 | 79538012 |
| 1448 | 5 | 78519893 | 79538048 |
| 1449 | 5 | 78519893 | 79538367 |
| 1450 | 5 | 78519893 | 79669824 |
| 1451 | 5 | 78519893 | 79682242 |
| 1452 | 5 | 78519893 | 79699261 |
| 1453 | 5 | 78519893 | 79710673 |
| 1454 | 5 | 78519893 | 79861902 |
| 1455 | 5 | 78519893 | 79867710 |
| 1456 | 5 | 78519893 | 79867868 |
| 1457 | 5 | 78519893 | 79867873 |
| 1458 | 5 | 78519893 | 79961961 |
| 1459 | 5 | 78519893 | 80086268 |
| 1460 | 5 | 78519893 | 80190673 |
| 1461 | 5 | 78519893 | 80190777 |
| 1462 | 5 | 78519893 | 80192546 |
| 1463 | 5 | 78519893 | 80195395 |
| 1464 | 5 | 78519893 | 80199923 |
| 1465 | 5 | 78519893 | 80241911 |
| 1466 | 5 | 78519893 | 80282785 |
| 1467 | 5 | 78519893 | 80345337 |
| 1468 | 5 | 78519893 | 80389787 |
| 1469 | 5 | 78519893 | 80411639 |
| 1470 | 5 | 78519893 | 80446855 |
| 1471 | 5 | 78519893 | 80492790 |
| 1472 | 5 | 78519893 | 80670554 |
| 1473 | 5 | 78519893 | 80674679 |
| 1474 | 5 | 78519893 | 80720509 |
| 1475 | 5 | 78519893 | 80800856 |
| 1476 | 5 | 78519893 | 80804587 |
| 1477 | 5 | 78519893 | 80807409 |
| 1478 | 5 | 78519893 | 80835734 |
| 1479 | 5 | 78519893 | 80971764 |
| 1480 | 5 | 78519893 | 80972258 |
| 1481 | 5 | 78519893 | 80974450 |
| 1482 | 5 | 78519893 | 81047638 |
| 1483 | 5 | 78519893 | 81082921 |
| 1484 | 5 | 78519893 | 81157909 |
| 1485 | 5 | 78519893 | 81265937 |
| 1486 | 5 | 78519893 | 81265937 |
| 1487 | 5 | 78519893 | 81267485 |
| 1488 | 5 | 78519893 | 81267499 |
| 1489 | 5 | 78519893 | 81274512 |
| 1490 | 5 | 78519893 | 81763618 |
| 1491 | 5 | 78519893 | 81797217 |
| 1492 | 5 | 78519893 | 81800186 |
| 1493 | 5 | 78519893 | 81806213 |
| 1494 | 5 | 78519893 | 81854583 |
| 1495 | 5 | 78519893 | 81859374 |
| 1496 | 5 | 78519893 | 81861368 |
| 1497 | 5 | 78519893 | 81863686 |
| 1498 | 5 | 78519893 | 81916850 |
| 1499 | 5 | 78519893 | 81954891 |
| 1500 | 5 | 78519893 | 81985250 |
| 1501 | 5 | 78519893 | 82083752 |
| 1502 | 5 | 78519893 | 82101253 |
| 1503 | 5 | 78519893 | 82143124 |
| 1504 | 5 | 78519893 | 82236318 |
| 1505 | 5 | 78519893 | 82325587 |
| 1506 | 5 | 78519893 | 82427210 |
| 1507 | 5 | 78519893 | 82431853 |
| 1508 | 5 | 78519893 | 82446714 |
| 1509 | 5 | 78519893 | 82446794 |
| 1510 | 5 | 78519893 | 82551111 |
| 1511 | 5 | 78519893 | 82552090 |
| 1512 | 5 | 78519893 | 82555641 |
| 1513 | 5 | 78519893 | 82555670 |
| 1514 | 5 | 78519893 | 82556511 |
| 1515 | 5 | 78519893 | 82559047 |
| 1516 | 5 | 78519893 | 82561535 |
| 1517 | 5 | 78519893 | 82610100 |
| 1518 | 5 | 78519893 | 82676822 |
| 1519 | 5 | 78519893 | 82676901 |
| 1520 | 5 | 78519893 | 82883691 |
| 1521 | 5 | 78519893 | 82954942 |
| 1522 | 5 | 78519893 | 82971688 |
| 1523 | 5 | 78519893 | 83023965 |
| 1524 | 5 | 78519893 | 83094205 |
| 1525 | 5 | 78519893 | 83146355 |
| 1526 | 5 | 78519893 | 83280630 |
| 1527 | 5 | 78519893 | 83281412 |
| 1528 | 5 | 78519893 | 83400242 |
| 1529 | 5 | 78519893 | 83405797 |
| 1530 | 5 | 78519893 | 83437132 |

TABLE 1-continued

Examples of chromosomal segments associated with increased fertility in maize.

| Chromosomal Segment | Chr. | Boundary 1 | Boundary 2 |
|---|---|---|---|
| 1531 | 5 | 78519893 | 83522252 |
| 1532 | 5 | 78519893 | 83560095 |
| 1533 | 5 | 78519893 | 83560204 |
| 1534 | 5 | 78519893 | 83572400 |
| 1535 | 5 | 78519893 | 83607661 |
| 1536 | 5 | 78519893 | 83745342 |
| 1537 | 5 | 78519893 | 83861275 |
| 1538 | 5 | 78519893 | 83861633 |
| 1539 | 5 | 78519893 | 83865653 |
| 1540 | 5 | 78519893 | 83865914 |
| 1541 | 5 | 78519893 | 83865920 |
| 1542 | 5 | 78519893 | 83868010 |
| 1543 | 5 | 78519893 | 84019752 |
| 1544 | 5 | 78519893 | 84065912 |
| 1545 | 5 | 78519893 | 84086632 |
| 1546 | 5 | 78519893 | 84089603 |
| 1547 | 5 | 78519893 | 84104814 |
| 1548 | 5 | 78519893 | 84105175 |
| 1549 | 5 | 78519893 | 84251635 |
| 1550 | 5 | 78519893 | 84252180 |
| 1551 | 5 | 78519893 | 84253030 |
| 1552 | 5 | 78519893 | 84254208 |
| 1553 | 5 | 78519893 | 84314930 |
| 1554 | 5 | 78519893 | 84340523 |
| 1555 | 5 | 78519893 | 84516340 |
| 1556 | 5 | 78519893 | 84706916 |
| 1557 | 5 | 78519893 | 84799488 |
| 1558 | 5 | 78519893 | 84801081 |
| 1559 | 5 | 78519893 | 84824103 |
| 1560 | 5 | 78519893 | 84824203 |
| 1561 | 5 | 78519893 | 84824816 |
| 1562 | 5 | 78519893 | 84825422 |
| 1563 | 5 | 78519893 | 84825763 |
| 1564 | 5 | 78519893 | 84825942 |
| 1565 | 5 | 78519893 | 84843411 |
| 1566 | 5 | 78519893 | 84936441 |
| 1567 | 5 | 78519893 | 84936493 |
| 1568 | 5 | 78519893 | 84943705 |
| 1569 | 5 | 78519893 | 169454950 |
| 1570 | 5 | 78519893 | 181522829 |
| 1571 | 5 | 78519893 | 204759879 |
| 1572 | 5 | 78519893 | 209874191 |
| 1573 | 5 | 78758856 | 78765635 |
| 1574 | 5 | 78758856 | 78780292 |
| 1575 | 5 | 78758856 | 78813114 |
| 1576 | 5 | 78758856 | 78814710 |
| 1577 | 5 | 78758856 | 78814976 |
| 1578 | 5 | 78758856 | 78815306 |
| 1579 | 5 | 78758856 | 78821393 |
| 1580 | 5 | 78758856 | 78826528 |
| 1581 | 5 | 78758856 | 78826538 |
| 1582 | 5 | 78758856 | 78826612 |
| 1583 | 5 | 78758856 | 78918620 |
| 1584 | 5 | 78758856 | 78918850 |
| 1585 | 5 | 78758856 | 79056960 |
| 1586 | 5 | 78758856 | 79163631 |
| 1587 | 5 | 78758856 | 79176557 |
| 1588 | 5 | 78758856 | 79188028 |
| 1589 | 5 | 78758856 | 79201760 |
| 1590 | 5 | 78758856 | 79230005 |
| 1591 | 5 | 78758856 | 79230318 |
| 1592 | 5 | 78758856 | 79505592 |
| 1593 | 5 | 78758856 | 79510072 |
| 1594 | 5 | 78758856 | 79538012 |
| 1595 | 5 | 78758856 | 79538048 |
| 1596 | 5 | 78758856 | 79538367 |
| 1597 | 5 | 78758856 | 79669824 |
| 1598 | 5 | 78758856 | 79682242 |
| 1599 | 5 | 78758856 | 79699261 |
| 1600 | 5 | 78758856 | 79710673 |
| 1601 | 5 | 78758856 | 79861902 |
| 1602 | 5 | 78758856 | 79867710 |
| 1603 | 5 | 78758856 | 79867868 |
| 1604 | 5 | 78758856 | 79867873 |
| 1605 | 5 | 78758856 | 79961961 |
| 1606 | 5 | 78758856 | 80086268 |
| 1607 | 5 | 78758856 | 80190673 |
| 1608 | 5 | 78758856 | 80190777 |
| 1609 | 5 | 78758856 | 80192546 |
| 1610 | 5 | 78758856 | 80195395 |
| 1611 | 5 | 78758856 | 80199923 |
| 1612 | 5 | 78758856 | 80241911 |
| 1613 | 5 | 78758856 | 80282785 |
| 1614 | 5 | 78758856 | 80345337 |
| 1615 | 5 | 78758856 | 80389787 |
| 1616 | 5 | 78758856 | 80411639 |
| 1617 | 5 | 78758856 | 80446855 |
| 1618 | 5 | 78758856 | 80492790 |
| 1619 | 5 | 78758856 | 80670554 |
| 1620 | 5 | 78758856 | 80674679 |
| 1621 | 5 | 78758856 | 80720509 |
| 1622 | 5 | 78758856 | 80800856 |
| 1623 | 5 | 78758856 | 80804587 |
| 1624 | 5 | 78758856 | 80807409 |
| 1625 | 5 | 78758856 | 80835734 |
| 1626 | 5 | 78758856 | 80971764 |
| 1627 | 5 | 78758856 | 80972258 |
| 1628 | 5 | 78758856 | 80974450 |
| 1629 | 5 | 78758856 | 81047638 |
| 1630 | 5 | 78758856 | 81082921 |
| 1631 | 5 | 78758856 | 81157909 |
| 1632 | 5 | 78758856 | 81265937 |
| 1633 | 5 | 78758856 | 81265937 |
| 1634 | 5 | 78758856 | 81267485 |
| 1635 | 5 | 78758856 | 81267499 |
| 1636 | 5 | 78758856 | 81274512 |
| 1637 | 5 | 78758856 | 81763618 |
| 1638 | 5 | 78758856 | 81797217 |
| 1639 | 5 | 78758856 | 81800186 |
| 1640 | 5 | 78758856 | 81806213 |
| 1641 | 5 | 78758856 | 81854583 |
| 1642 | 5 | 78758856 | 81859374 |
| 1643 | 5 | 78758856 | 81861368 |
| 1644 | 5 | 78758856 | 81863686 |
| 1645 | 5 | 78758856 | 81916850 |
| 1646 | 5 | 78758856 | 81954891 |
| 1647 | 5 | 78758856 | 81985250 |
| 1648 | 5 | 78758856 | 82083752 |
| 1649 | 5 | 78758856 | 82101253 |
| 1650 | 5 | 78758856 | 82143124 |
| 1651 | 5 | 78758856 | 82236318 |
| 1652 | 5 | 78758856 | 82325587 |
| 1653 | 5 | 78758856 | 82427210 |
| 1654 | 5 | 78758856 | 82431853 |
| 1655 | 5 | 78758856 | 82446714 |
| 1656 | 5 | 78758856 | 82446794 |
| 1657 | 5 | 78758856 | 82551111 |
| 1658 | 5 | 78758856 | 82552090 |
| 1659 | 5 | 78758856 | 82555641 |
| 1660 | 5 | 78758856 | 82555670 |
| 1661 | 5 | 78758856 | 82556511 |
| 1662 | 5 | 78758856 | 82559047 |
| 1663 | 5 | 78758856 | 82561535 |
| 1664 | 5 | 78758856 | 82610100 |
| 1665 | 5 | 78758856 | 82676822 |
| 1666 | 5 | 78758856 | 82676901 |
| 1667 | 5 | 78758856 | 82883691 |
| 1668 | 5 | 78758856 | 82954942 |
| 1669 | 5 | 78758856 | 82971688 |
| 1670 | 5 | 78758856 | 83023965 |
| 1671 | 5 | 78758856 | 83094205 |
| 1672 | 5 | 78758856 | 83146355 |
| 1673 | 5 | 78758856 | 83280630 |
| 1674 | 5 | 78758856 | 83281412 |
| 1675 | 5 | 78758856 | 83400242 |
| 1676 | 5 | 78758856 | 83405797 |
| 1677 | 5 | 78758856 | 83437132 |
| 1678 | 5 | 78758856 | 83522252 |

TABLE 1-continued

Examples of chromosomal segments associated with increased fertility in maize.

| Chromosomal Segment | Chr. | Boundary 1 | Boundary 2 |
|---|---|---|---|
| 1679 | 5 | 78758856 | 83560095 |
| 1680 | 5 | 78758856 | 83560204 |
| 1681 | 5 | 78758856 | 83572400 |
| 1682 | 5 | 78758856 | 83607661 |
| 1683 | 5 | 78758856 | 83745342 |
| 1684 | 5 | 78758856 | 83861275 |
| 1685 | 5 | 78758856 | 83861633 |
| 1686 | 5 | 78758856 | 83865653 |
| 1687 | 5 | 78758856 | 83865914 |
| 1688 | 5 | 78758856 | 83865920 |
| 1689 | 5 | 78758856 | 83868010 |
| 1690 | 5 | 78758856 | 84019752 |
| 1691 | 5 | 78758856 | 84065912 |
| 1692 | 5 | 78758856 | 84086632 |
| 1693 | 5 | 78758856 | 84089603 |
| 1694 | 5 | 78758856 | 84104814 |
| 1695 | 5 | 78758856 | 84105175 |
| 1696 | 5 | 78758856 | 84251635 |
| 1697 | 5 | 78758856 | 84252180 |
| 1698 | 5 | 78758856 | 84253030 |
| 1699 | 5 | 78758856 | 84254208 |
| 1700 | 5 | 78758856 | 84314930 |
| 1701 | 5 | 78758856 | 84340523 |
| 1702 | 5 | 78758856 | 84516340 |
| 1703 | 5 | 78758856 | 84706916 |
| 1704 | 5 | 78758856 | 84799488 |
| 1705 | 5 | 78758856 | 84801081 |
| 1706 | 5 | 78758856 | 84824103 |
| 1707 | 5 | 78758856 | 84824203 |
| 1708 | 5 | 78758856 | 84824816 |
| 1709 | 5 | 78758856 | 84825422 |
| 1710 | 5 | 78758856 | 84825763 |
| 1711 | 5 | 78758856 | 84825942 |
| 1712 | 5 | 78758856 | 84843411 |
| 1713 | 5 | 78758856 | 84936441 |
| 1714 | 5 | 78758856 | 84936493 |
| 1715 | 5 | 78758856 | 84943705 |
| 1716 | 5 | 78758856 | 169454950 |
| 1717 | 5 | 78758856 | 181522829 |
| 1718 | 5 | 78758856 | 204759879 |
| 1719 | 5 | 78758856 | 209874191 |
| 1720 | 5 | 78772058 | 78780292 |
| 1721 | 5 | 78772058 | 78813114 |
| 1722 | 5 | 78772058 | 78814710 |
| 1723 | 5 | 78772058 | 78814976 |
| 1724 | 5 | 78772058 | 78815306 |
| 1725 | 5 | 78772058 | 78821393 |
| 1726 | 5 | 78772058 | 78826528 |
| 1727 | 5 | 78772058 | 78826538 |
| 1728 | 5 | 78772058 | 78826612 |
| 1729 | 5 | 78772058 | 78918620 |
| 1730 | 5 | 78772058 | 78918850 |
| 1731 | 5 | 78772058 | 79056960 |
| 1732 | 5 | 78772058 | 79163631 |
| 1733 | 5 | 78772058 | 79176557 |
| 1734 | 5 | 78772058 | 79188028 |
| 1735 | 5 | 78772058 | 79201760 |
| 1736 | 5 | 78772058 | 79230005 |
| 1737 | 5 | 78772058 | 79230318 |
| 1738 | 5 | 78772058 | 79505592 |
| 1739 | 5 | 78772058 | 79510072 |
| 1740 | 5 | 78772058 | 79538012 |
| 1741 | 5 | 78772058 | 79538048 |
| 1742 | 5 | 78772058 | 79538367 |
| 1743 | 5 | 78772058 | 79669824 |
| 1744 | 5 | 78772058 | 79682242 |
| 1745 | 5 | 78772058 | 79699261 |
| 1746 | 5 | 78772058 | 79710673 |
| 1747 | 5 | 78772058 | 79861902 |
| 1748 | 5 | 78772058 | 79867710 |
| 1749 | 5 | 78772058 | 79867868 |
| 1750 | 5 | 78772058 | 79867873 |
| 1751 | 5 | 78772058 | 79961961 |
| 1752 | 5 | 78772058 | 80086268 |
| 1753 | 5 | 78772058 | 80190673 |
| 1754 | 5 | 78772058 | 80190777 |
| 1755 | 5 | 78772058 | 80192546 |
| 1756 | 5 | 78772058 | 80195395 |
| 1757 | 5 | 78772058 | 80199923 |
| 1758 | 5 | 78772058 | 80241911 |
| 1759 | 5 | 78772058 | 80282785 |
| 1760 | 5 | 78772058 | 80345337 |
| 1761 | 5 | 78772058 | 80389787 |
| 1762 | 5 | 78772058 | 80411639 |
| 1763 | 5 | 78772058 | 80446855 |
| 1764 | 5 | 78772058 | 80492790 |
| 1765 | 5 | 78772058 | 80670554 |
| 1766 | 5 | 78772058 | 80674679 |
| 1767 | 5 | 78772058 | 80720509 |
| 1768 | 5 | 78772058 | 80800856 |
| 1769 | 5 | 78772058 | 80804587 |
| 1770 | 5 | 78772058 | 80807409 |
| 1771 | 5 | 78772058 | 80835734 |
| 1772 | 5 | 78772058 | 80971764 |
| 1773 | 5 | 78772058 | 80972258 |
| 1774 | 5 | 78772058 | 80974450 |
| 1775 | 5 | 78772058 | 81047638 |
| 1776 | 5 | 78772058 | 81082921 |
| 1777 | 5 | 78772058 | 81157909 |
| 1778 | 5 | 78772058 | 81265937 |
| 1779 | 5 | 78772058 | 81265937 |
| 1780 | 5 | 78772058 | 81267485 |
| 1781 | 5 | 78772058 | 81267499 |
| 1782 | 5 | 78772058 | 81274512 |
| 1783 | 5 | 78772058 | 81763618 |
| 1784 | 5 | 78772058 | 81797217 |
| 1785 | 5 | 78772058 | 81800186 |
| 1786 | 5 | 78772058 | 81806213 |
| 1787 | 5 | 78772058 | 81854583 |
| 1788 | 5 | 78772058 | 81859374 |
| 1789 | 5 | 78772058 | 81861368 |
| 1790 | 5 | 78772058 | 81863686 |
| 1791 | 5 | 78772058 | 81916850 |
| 1792 | 5 | 78772058 | 81954891 |
| 1793 | 5 | 78772058 | 81985250 |
| 1794 | 5 | 78772058 | 82083752 |
| 1795 | 5 | 78772058 | 82101253 |
| 1796 | 5 | 78772058 | 82143124 |
| 1797 | 5 | 78772058 | 82236318 |
| 1798 | 5 | 78772058 | 82325587 |
| 1799 | 5 | 78772058 | 82427210 |
| 1800 | 5 | 78772058 | 82431853 |
| 1801 | 5 | 78772058 | 82446714 |
| 1802 | 5 | 78772058 | 82446794 |
| 1803 | 5 | 78772058 | 82551111 |
| 1804 | 5 | 78772058 | 82552090 |
| 1805 | 5 | 78772058 | 82555641 |
| 1806 | 5 | 78772058 | 82555670 |
| 1807 | 5 | 78772058 | 82556511 |
| 1808 | 5 | 78772058 | 82559047 |
| 1809 | 5 | 78772058 | 82561535 |
| 1810 | 5 | 78772058 | 82610100 |
| 1811 | 5 | 78772058 | 82676822 |
| 1812 | 5 | 78772058 | 82676901 |
| 1813 | 5 | 78772058 | 82883691 |
| 1814 | 5 | 78772058 | 82954942 |
| 1815 | 5 | 78772058 | 82971688 |
| 1816 | 5 | 78772058 | 83023965 |
| 1817 | 5 | 78772058 | 83094205 |
| 1818 | 5 | 78772058 | 83146355 |
| 1819 | 5 | 78772058 | 83280630 |
| 1820 | 5 | 78772058 | 83281412 |
| 1821 | 5 | 78772058 | 83400242 |
| 1822 | 5 | 78772058 | 83405797 |
| 1823 | 5 | 78772058 | 83437132 |
| 1824 | 5 | 78772058 | 83522252 |
| 1825 | 5 | 78772058 | 83560095 |
| 1826 | 5 | 78772058 | 83560204 |

TABLE 1-continued

Examples of chromosomal segments associated with increased fertility in maize.

| Chromosomal Segment | Chr. | Boundary 1 | Boundary 2 |
|---|---|---|---|
| 1827 | 5 | 78772058 | 83572400 |
| 1828 | 5 | 78772058 | 83607661 |
| 1829 | 5 | 78772058 | 83745342 |
| 1830 | 5 | 78772058 | 83861275 |
| 1831 | 5 | 78772058 | 83861633 |
| 1832 | 5 | 78772058 | 83865653 |
| 1833 | 5 | 78772058 | 83865914 |
| 1834 | 5 | 78772058 | 83865920 |
| 1835 | 5 | 78772058 | 83868010 |
| 1836 | 5 | 78772058 | 84019752 |
| 1837 | 5 | 78772058 | 84065912 |
| 1838 | 5 | 78772058 | 84086632 |
| 1839 | 5 | 78772058 | 84089603 |
| 1840 | 5 | 78772058 | 84104814 |
| 1841 | 5 | 78772058 | 84105175 |
| 1842 | 5 | 78772058 | 84251635 |
| 1843 | 5 | 78772058 | 84252180 |
| 1844 | 5 | 78772058 | 84253030 |
| 1845 | 5 | 78772058 | 84254208 |
| 1846 | 5 | 78772058 | 84314930 |
| 1847 | 5 | 78772058 | 84340523 |
| 1848 | 5 | 78772058 | 84516340 |
| 1849 | 5 | 78772058 | 84706916 |
| 1850 | 5 | 78772058 | 84799488 |
| 1851 | 5 | 78772058 | 84801081 |
| 1852 | 5 | 78772058 | 84824103 |
| 1853 | 5 | 78772058 | 84824203 |
| 1854 | 5 | 78772058 | 84824816 |
| 1855 | 5 | 78772058 | 84825422 |
| 1856 | 5 | 78772058 | 84825763 |
| 1857 | 5 | 78772058 | 84825942 |
| 1858 | 5 | 78772058 | 84843411 |
| 1859 | 5 | 78772058 | 84936441 |
| 1860 | 5 | 78772058 | 84936493 |
| 1861 | 5 | 78772058 | 84943705 |
| 1862 | 5 | 78772058 | 169454950 |
| 1863 | 5 | 78772058 | 181522829 |
| 1864 | 5 | 78772058 | 204759879 |
| 1865 | 5 | 78772058 | 209874191 |
| 1866 | 5 | 78804756 | 78813114 |
| 1867 | 5 | 78804756 | 78814710 |
| 1868 | 5 | 78804756 | 78814976 |
| 1869 | 5 | 78804756 | 78815306 |
| 1870 | 5 | 78804756 | 78821393 |
| 1871 | 5 | 78804756 | 78826528 |
| 1872 | 5 | 78804756 | 78826538 |
| 1873 | 5 | 78804756 | 78826612 |
| 1874 | 5 | 78804756 | 78918620 |
| 1875 | 5 | 78804756 | 78918850 |
| 1876 | 5 | 78804756 | 79056960 |
| 1877 | 5 | 78804756 | 79163631 |
| 1878 | 5 | 78804756 | 79176557 |
| 1879 | 5 | 78804756 | 79188028 |
| 1880 | 5 | 78804756 | 79201760 |
| 1881 | 5 | 78804756 | 79230005 |
| 1882 | 5 | 78804756 | 79230318 |
| 1883 | 5 | 78804756 | 79505592 |
| 1884 | 5 | 78804756 | 79510072 |
| 1885 | 5 | 78804756 | 79538012 |
| 1886 | 5 | 78804756 | 79538048 |
| 1887 | 5 | 78804756 | 79538367 |
| 1888 | 5 | 78804756 | 79669824 |
| 1889 | 5 | 78804756 | 79682242 |
| 1890 | 5 | 78804756 | 79699261 |
| 1891 | 5 | 78804756 | 79710673 |
| 1892 | 5 | 78804756 | 79861902 |
| 1893 | 5 | 78804756 | 79867710 |
| 1894 | 5 | 78804756 | 79867868 |
| 1895 | 5 | 78804756 | 79867873 |
| 1896 | 5 | 78804756 | 79961961 |
| 1897 | 5 | 78804756 | 80086268 |
| 1898 | 5 | 78804756 | 80190673 |
| 1899 | 5 | 78804756 | 80190777 |
| 1900 | 5 | 78804756 | 80192546 |
| 1901 | 5 | 78804756 | 80195395 |
| 1902 | 5 | 78804756 | 80199923 |
| 1903 | 5 | 78804756 | 80241911 |
| 1904 | 5 | 78804756 | 80282785 |
| 1905 | 5 | 78804756 | 80345337 |
| 1906 | 5 | 78804756 | 80389787 |
| 1907 | 5 | 78804756 | 80411639 |
| 1908 | 5 | 78804756 | 80446855 |
| 1909 | 5 | 78804756 | 80492790 |
| 1910 | 5 | 78804756 | 80670554 |
| 1911 | 5 | 78804756 | 80674679 |
| 1912 | 5 | 78804756 | 80720509 |
| 1913 | 5 | 78804756 | 80800856 |
| 1914 | 5 | 78804756 | 80804587 |
| 1915 | 5 | 78804756 | 80807409 |
| 1916 | 5 | 78804756 | 80835734 |
| 1917 | 5 | 78804756 | 80971764 |
| 1918 | 5 | 78804756 | 80972258 |
| 1919 | 5 | 78804756 | 80974450 |
| 1920 | 5 | 78804756 | 81047638 |
| 1921 | 5 | 78804756 | 81082921 |
| 1922 | 5 | 78804756 | 81157909 |
| 1923 | 5 | 78804756 | 81265937 |
| 1924 | 5 | 78804756 | 81265937 |
| 1925 | 5 | 78804756 | 81267485 |
| 1926 | 5 | 78804756 | 81267499 |
| 1927 | 5 | 78804756 | 81274512 |
| 1928 | 5 | 78804756 | 81763618 |
| 1929 | 5 | 78804756 | 81797217 |
| 1930 | 5 | 78804756 | 81800186 |
| 1931 | 5 | 78804756 | 81806213 |
| 1932 | 5 | 78804756 | 81854583 |
| 1933 | 5 | 78804756 | 81859374 |
| 1934 | 5 | 78804756 | 81861368 |
| 1935 | 5 | 78804756 | 81863686 |
| 1936 | 5 | 78804756 | 81916850 |
| 1937 | 5 | 78804756 | 81954891 |
| 1938 | 5 | 78804756 | 81985250 |
| 1939 | 5 | 78804756 | 82083752 |
| 1940 | 5 | 78804756 | 82101253 |
| 1941 | 5 | 78804756 | 82143124 |
| 1942 | 5 | 78804756 | 82236318 |
| 1943 | 5 | 78804756 | 82325587 |
| 1944 | 5 | 78804756 | 82427210 |
| 1945 | 5 | 78804756 | 82431853 |
| 1946 | 5 | 78804756 | 82446714 |
| 1947 | 5 | 78804756 | 82446794 |
| 1948 | 5 | 78804756 | 82551111 |
| 1949 | 5 | 78804756 | 82552090 |
| 1950 | 5 | 78804756 | 82555641 |
| 1951 | 5 | 78804756 | 82555670 |
| 1952 | 5 | 78804756 | 82556511 |
| 1953 | 5 | 78804756 | 82559047 |
| 1954 | 5 | 78804756 | 82561535 |
| 1955 | 5 | 78804756 | 82610100 |
| 1956 | 5 | 78804756 | 82676822 |
| 1957 | 5 | 78804756 | 82676901 |
| 1958 | 5 | 78804756 | 82883691 |
| 1959 | 5 | 78804756 | 82954942 |
| 1960 | 5 | 78804756 | 82971688 |
| 1961 | 5 | 78804756 | 83023965 |
| 1962 | 5 | 78804756 | 83094205 |
| 1963 | 5 | 78804756 | 83146355 |
| 1964 | 5 | 78804756 | 83280630 |
| 1965 | 5 | 78804756 | 83281412 |
| 1966 | 5 | 78804756 | 83400242 |
| 1967 | 5 | 78804756 | 83405797 |
| 1968 | 5 | 78804756 | 83437132 |
| 1969 | 5 | 78804756 | 83522252 |
| 1970 | 5 | 78804756 | 83560095 |
| 1971 | 5 | 78804756 | 83560204 |
| 1972 | 5 | 78804756 | 83572400 |
| 1973 | 5 | 78804756 | 83607661 |
| 1974 | 5 | 78804756 | 83745342 |

TABLE 1-continued

Examples of chromosomal segments associated with increased fertility in maize.

| Chromosomal Segment | Chr. | Boundary 1 | Boundary 2 |
|---|---|---|---|
| 1975 | 5 | 78804756 | 83861275 |
| 1976 | 5 | 78804756 | 83861633 |
| 1977 | 5 | 78804756 | 83865653 |
| 1978 | 5 | 78804756 | 83865914 |
| 1979 | 5 | 78804756 | 83865920 |
| 1980 | 5 | 78804756 | 83868010 |
| 1981 | 5 | 78804756 | 84019752 |
| 1982 | 5 | 78804756 | 84065912 |
| 1983 | 5 | 78804756 | 84086632 |
| 1984 | 5 | 78804756 | 84089603 |
| 1985 | 5 | 78804756 | 84104814 |
| 1986 | 5 | 78804756 | 84105175 |
| 1987 | 5 | 78804756 | 84251635 |
| 1988 | 5 | 78804756 | 84252180 |
| 1989 | 5 | 78804756 | 84253030 |
| 1990 | 5 | 78804756 | 84254208 |
| 1991 | 5 | 78804756 | 84314930 |
| 1992 | 5 | 78804756 | 84340523 |
| 1993 | 5 | 78804756 | 84516340 |
| 1994 | 5 | 78804756 | 84706916 |
| 1995 | 5 | 78804756 | 84799488 |
| 1996 | 5 | 78804756 | 84801081 |
| 1997 | 5 | 78804756 | 84824103 |
| 1998 | 5 | 78804756 | 84824203 |
| 1999 | 5 | 78804756 | 84824816 |
| 2000 | 5 | 78804756 | 84825422 |
| 2001 | 5 | 78804756 | 84825763 |
| 2002 | 5 | 78804756 | 84825942 |
| 2003 | 5 | 78804756 | 84843411 |
| 2004 | 5 | 78804756 | 84936441 |
| 2005 | 5 | 78804756 | 84936493 |
| 2006 | 5 | 78804756 | 84943705 |
| 2007 | 5 | 78804756 | 169454950 |
| 2008 | 5 | 78804756 | 181522829 |
| 2009 | 5 | 78804756 | 204759879 |
| 2010 | 5 | 78804756 | 209874191 |
| 2011 | 5 | 78805059 | 78813114 |
| 2012 | 5 | 78805059 | 78814710 |
| 2013 | 5 | 78805059 | 78814976 |
| 2014 | 5 | 78805059 | 78815306 |
| 2015 | 5 | 78805059 | 78821393 |
| 2016 | 5 | 78805059 | 78826528 |
| 2017 | 5 | 78805059 | 78826538 |
| 2018 | 5 | 78805059 | 78826612 |
| 2019 | 5 | 78805059 | 78918620 |
| 2020 | 5 | 78805059 | 78918850 |
| 2021 | 5 | 78805059 | 79056960 |
| 2022 | 5 | 78805059 | 79163631 |
| 2023 | 5 | 78805059 | 79176557 |
| 2024 | 5 | 78805059 | 79188028 |
| 2025 | 5 | 78805059 | 79201760 |
| 2026 | 5 | 78805059 | 79230005 |
| 2027 | 5 | 78805059 | 79230318 |
| 2028 | 5 | 78805059 | 79505592 |
| 2029 | 5 | 78805059 | 79510072 |
| 2030 | 5 | 78805059 | 79538012 |
| 2031 | 5 | 78805059 | 79538048 |
| 2032 | 5 | 78805059 | 79538367 |
| 2033 | 5 | 78805059 | 79669824 |
| 2034 | 5 | 78805059 | 79682242 |
| 2035 | 5 | 78805059 | 79699261 |
| 2036 | 5 | 78805059 | 79710673 |
| 2037 | 5 | 78805059 | 79861902 |
| 2038 | 5 | 78805059 | 79867710 |
| 2039 | 5 | 78805059 | 79867868 |
| 2040 | 5 | 78805059 | 79867873 |
| 2041 | 5 | 78805059 | 79961961 |
| 2042 | 5 | 78805059 | 80086268 |
| 2043 | 5 | 78805059 | 80190673 |
| 2044 | 5 | 78805059 | 80190777 |
| 2045 | 5 | 78805059 | 80192546 |
| 2046 | 5 | 78805059 | 80195395 |
| 2047 | 5 | 78805059 | 80199923 |
| 2048 | 5 | 78805059 | 80241911 |
| 2049 | 5 | 78805059 | 80282785 |
| 2050 | 5 | 78805059 | 80345337 |
| 2051 | 5 | 78805059 | 80389787 |
| 2052 | 5 | 78805059 | 80411639 |
| 2053 | 5 | 78805059 | 80446855 |
| 2054 | 5 | 78805059 | 80492790 |
| 2055 | 5 | 78805059 | 80670554 |
| 2056 | 5 | 78805059 | 80674679 |
| 2057 | 5 | 78805059 | 80720509 |
| 2058 | 5 | 78805059 | 80800856 |
| 2059 | 5 | 78805059 | 80804587 |
| 2060 | 5 | 78805059 | 80807409 |
| 2061 | 5 | 78805059 | 80835734 |
| 2062 | 5 | 78805059 | 80971764 |
| 2063 | 5 | 78805059 | 80972258 |
| 2064 | 5 | 78805059 | 80974450 |
| 2065 | 5 | 78805059 | 81047638 |
| 2066 | 5 | 78805059 | 81082921 |
| 2067 | 5 | 78805059 | 81157909 |
| 2068 | 5 | 78805059 | 81265937 |
| 2069 | 5 | 78805059 | 81265937 |
| 2070 | 5 | 78805059 | 81267485 |
| 2071 | 5 | 78805059 | 81267499 |
| 2072 | 5 | 78805059 | 81274512 |
| 2073 | 5 | 78805059 | 81763618 |
| 2074 | 5 | 78805059 | 81797217 |
| 2075 | 5 | 78805059 | 81800186 |
| 2076 | 5 | 78805059 | 81806213 |
| 2077 | 5 | 78805059 | 81854583 |
| 2078 | 5 | 78805059 | 81859374 |
| 2079 | 5 | 78805059 | 81861368 |
| 2080 | 5 | 78805059 | 81863686 |
| 2081 | 5 | 78805059 | 81916850 |
| 2082 | 5 | 78805059 | 81954891 |
| 2083 | 5 | 78805059 | 81985250 |
| 2084 | 5 | 78805059 | 82083752 |
| 2085 | 5 | 78805059 | 82101253 |
| 2086 | 5 | 78805059 | 82143124 |
| 2087 | 5 | 78805059 | 82236318 |
| 2088 | 5 | 78805059 | 82325587 |
| 2089 | 5 | 78805059 | 82427210 |
| 2090 | 5 | 78805059 | 82431853 |
| 2091 | 5 | 78805059 | 82446714 |
| 2092 | 5 | 78805059 | 82446794 |
| 2093 | 5 | 78805059 | 82551111 |
| 2094 | 5 | 78805059 | 82552090 |
| 2095 | 5 | 78805059 | 82555641 |
| 2096 | 5 | 78805059 | 82555670 |
| 2097 | 5 | 78805059 | 82556511 |
| 2098 | 5 | 78805059 | 82559047 |
| 2099 | 5 | 78805059 | 82561535 |
| 2100 | 5 | 78805059 | 82610100 |
| 2101 | 5 | 78805059 | 82676822 |
| 2102 | 5 | 78805059 | 82676901 |
| 2103 | 5 | 78805059 | 82883691 |
| 2104 | 5 | 78805059 | 82954942 |
| 2105 | 5 | 78805059 | 82971688 |
| 2106 | 5 | 78805059 | 83023965 |
| 2107 | 5 | 78805059 | 83094205 |
| 2108 | 5 | 78805059 | 83146355 |
| 2109 | 5 | 78805059 | 83280630 |
| 2110 | 5 | 78805059 | 83281412 |
| 2111 | 5 | 78805059 | 83400242 |
| 2112 | 5 | 78805059 | 83405797 |
| 2113 | 5 | 78805059 | 83437132 |
| 2114 | 5 | 78805059 | 83522252 |
| 2115 | 5 | 78805059 | 83560095 |
| 2116 | 5 | 78805059 | 83560204 |
| 2117 | 5 | 78805059 | 83572400 |
| 2118 | 5 | 78805059 | 83607661 |
| 2119 | 5 | 78805059 | 83745342 |
| 2120 | 5 | 78805059 | 83861275 |
| 2121 | 5 | 78805059 | 83861633 |
| 2122 | 5 | 78805059 | 83865653 |

TABLE 1-continued

Examples of chromosomal segments associated with increased fertility in maize.

| Chromosomal Segment | Chr. | Boundary 1 | Boundary 2 |
|---|---|---|---|
| 2123 | 5 | 78805059 | 83865914 |
| 2124 | 5 | 78805059 | 83865920 |
| 2125 | 5 | 78805059 | 83868010 |
| 2126 | 5 | 78805059 | 84019752 |
| 2127 | 5 | 78805059 | 84065912 |
| 2128 | 5 | 78805059 | 84086632 |
| 2129 | 5 | 78805059 | 84089603 |
| 2130 | 5 | 78805059 | 84104814 |
| 2131 | 5 | 78805059 | 84105175 |
| 2132 | 5 | 78805059 | 84251635 |
| 2133 | 5 | 78805059 | 84252180 |
| 2134 | 5 | 78805059 | 84253030 |
| 2135 | 5 | 78805059 | 84254208 |
| 2136 | 5 | 78805059 | 84314930 |
| 2137 | 5 | 78805059 | 84340523 |
| 2138 | 5 | 78805059 | 84516340 |
| 2139 | 5 | 78805059 | 84706916 |
| 2140 | 5 | 78805059 | 84799488 |
| 2141 | 5 | 78805059 | 84801081 |
| 2142 | 5 | 78805059 | 84824103 |
| 2143 | 5 | 78805059 | 84824203 |
| 2144 | 5 | 78805059 | 84824816 |
| 2145 | 5 | 78805059 | 84825422 |
| 2146 | 5 | 78805059 | 84825763 |
| 2147 | 5 | 78805059 | 84825942 |
| 2148 | 5 | 78805059 | 84843411 |
| 2149 | 5 | 78805059 | 84936441 |
| 2150 | 5 | 78805059 | 84936493 |
| 2151 | 5 | 78805059 | 84943705 |
| 2152 | 5 | 78805059 | 169454950 |
| 2153 | 5 | 78805059 | 181522829 |
| 2154 | 5 | 78805059 | 204759879 |
| 2155 | 5 | 78805059 | 209874191 |
| 2156 | 5 | 78814424 | 78814710 |
| 2157 | 5 | 78814424 | 78814976 |
| 2158 | 5 | 78814424 | 78815306 |
| 2159 | 5 | 78814424 | 78821393 |
| 2160 | 5 | 78814424 | 78826528 |
| 2161 | 5 | 78814424 | 78826538 |
| 2162 | 5 | 78814424 | 78826612 |
| 2163 | 5 | 78814424 | 78918620 |
| 2164 | 5 | 78814424 | 78918850 |
| 2165 | 5 | 78814424 | 79056960 |
| 2166 | 5 | 78814424 | 79163631 |
| 2167 | 5 | 78814424 | 79176557 |
| 2168 | 5 | 78814424 | 79188028 |
| 2169 | 5 | 78814424 | 79201760 |
| 2170 | 5 | 78814424 | 79230005 |
| 2171 | 5 | 78814424 | 79230318 |
| 2172 | 5 | 78814424 | 79505592 |
| 2173 | 5 | 78814424 | 79510072 |
| 2174 | 5 | 78814424 | 79538012 |
| 2175 | 5 | 78814424 | 79538048 |
| 2176 | 5 | 78814424 | 79538367 |
| 2177 | 5 | 78814424 | 79669824 |
| 2178 | 5 | 78814424 | 79682242 |
| 2179 | 5 | 78814424 | 79699261 |
| 2180 | 5 | 78814424 | 79710673 |
| 2181 | 5 | 78814424 | 79861902 |
| 2182 | 5 | 78814424 | 79867710 |
| 2183 | 5 | 78814424 | 79867868 |
| 2184 | 5 | 78814424 | 79867873 |
| 2185 | 5 | 78814424 | 79961961 |
| 2186 | 5 | 78814424 | 80086268 |
| 2187 | 5 | 78814424 | 80190673 |
| 2188 | 5 | 78814424 | 80190777 |
| 2189 | 5 | 78814424 | 80192546 |
| 2190 | 5 | 78814424 | 80195395 |
| 2191 | 5 | 78814424 | 80199923 |
| 2192 | 5 | 78814424 | 80241911 |
| 2193 | 5 | 78814424 | 80282785 |
| 2194 | 5 | 78814424 | 80345337 |
| 2195 | 5 | 78814424 | 80389787 |
| 2196 | 5 | 78814424 | 80411639 |
| 2197 | 5 | 78814424 | 80446855 |
| 2198 | 5 | 78814424 | 80492790 |
| 2199 | 5 | 78814424 | 80670554 |
| 2200 | 5 | 78814424 | 80674679 |
| 2201 | 5 | 78814424 | 80720509 |
| 2202 | 5 | 78814424 | 80800856 |
| 2203 | 5 | 78814424 | 80804587 |
| 2204 | 5 | 78814424 | 80807409 |
| 2205 | 5 | 78814424 | 80835734 |
| 2206 | 5 | 78814424 | 80971764 |
| 2207 | 5 | 78814424 | 80972258 |
| 2208 | 5 | 78814424 | 80974450 |
| 2209 | 5 | 78814424 | 81047638 |
| 2210 | 5 | 78814424 | 81082921 |
| 2211 | 5 | 78814424 | 81157909 |
| 2212 | 5 | 78814424 | 81265937 |
| 2213 | 5 | 78814424 | 81265937 |
| 2214 | 5 | 78814424 | 81267485 |
| 2215 | 5 | 78814424 | 81267499 |
| 2216 | 5 | 78814424 | 81274512 |
| 2217 | 5 | 78814424 | 81763618 |
| 2218 | 5 | 78814424 | 81797217 |
| 2219 | 5 | 78814424 | 81800186 |
| 2220 | 5 | 78814424 | 81806213 |
| 2221 | 5 | 78814424 | 81854583 |
| 2222 | 5 | 78814424 | 81859374 |
| 2223 | 5 | 78814424 | 81861368 |
| 2224 | 5 | 78814424 | 81863686 |
| 2225 | 5 | 78814424 | 81916850 |
| 2226 | 5 | 78814424 | 81954891 |
| 2227 | 5 | 78814424 | 81985250 |
| 2228 | 5 | 78814424 | 82083752 |
| 2229 | 5 | 78814424 | 82101253 |
| 2230 | 5 | 78814424 | 82143124 |
| 2231 | 5 | 78814424 | 82236318 |
| 2232 | 5 | 78814424 | 82325587 |
| 2233 | 5 | 78814424 | 82427210 |
| 2234 | 5 | 78814424 | 82431853 |
| 2235 | 5 | 78814424 | 82446714 |
| 2236 | 5 | 78814424 | 82446794 |
| 2237 | 5 | 78814424 | 82551111 |
| 2238 | 5 | 78814424 | 82552090 |
| 2239 | 5 | 78814424 | 82555641 |
| 2240 | 5 | 78814424 | 82555670 |
| 2241 | 5 | 78814424 | 82556511 |
| 2242 | 5 | 78814424 | 82559047 |
| 2243 | 5 | 78814424 | 82561535 |
| 2244 | 5 | 78814424 | 82610100 |
| 2245 | 5 | 78814424 | 82676822 |
| 2246 | 5 | 78814424 | 82676901 |
| 2247 | 5 | 78814424 | 82883691 |
| 2248 | 5 | 78814424 | 82954942 |
| 2249 | 5 | 78814424 | 82971688 |
| 2250 | 5 | 78814424 | 83023965 |
| 2251 | 5 | 78814424 | 83094205 |
| 2252 | 5 | 78814424 | 83146355 |
| 2253 | 5 | 78814424 | 83280630 |
| 2254 | 5 | 78814424 | 83281412 |
| 2255 | 5 | 78814424 | 83400242 |
| 2256 | 5 | 78814424 | 83405797 |
| 2257 | 5 | 78814424 | 83437132 |
| 2258 | 5 | 78814424 | 83522252 |
| 2259 | 5 | 78814424 | 83560095 |
| 2260 | 5 | 78814424 | 83560204 |
| 2261 | 5 | 78814424 | 83572400 |
| 2262 | 5 | 78814424 | 83607661 |
| 2263 | 5 | 78814424 | 83745342 |
| 2264 | 5 | 78814424 | 83861275 |
| 2265 | 5 | 78814424 | 83861633 |
| 2266 | 5 | 78814424 | 83865653 |
| 2267 | 5 | 78814424 | 83865914 |
| 2268 | 5 | 78814424 | 83865920 |
| 2269 | 5 | 78814424 | 83868010 |
| 2270 | 5 | 78814424 | 84019752 |

TABLE 1-continued

Examples of chromosomal segments associated with increased fertility in maize.

| Chromosomal Segment | Chr. | Boundary 1 | Boundary 2 |
|---|---|---|---|
| 2271 | 5 | 78814424 | 84065912 |
| 2272 | 5 | 78814424 | 84086632 |
| 2273 | 5 | 78814424 | 84089603 |
| 2274 | 5 | 78814424 | 84104814 |
| 2275 | 5 | 78814424 | 84105175 |
| 2276 | 5 | 78814424 | 84251635 |
| 2277 | 5 | 78814424 | 84252180 |
| 2278 | 5 | 78814424 | 84253030 |
| 2279 | 5 | 78814424 | 84254208 |
| 2280 | 5 | 78814424 | 84314930 |
| 2281 | 5 | 78814424 | 84340523 |
| 2282 | 5 | 78814424 | 84516340 |
| 2283 | 5 | 78814424 | 84706916 |
| 2284 | 5 | 78814424 | 84799488 |
| 2285 | 5 | 78814424 | 84801081 |
| 2286 | 5 | 78814424 | 84824103 |
| 2287 | 5 | 78814424 | 84824203 |
| 2288 | 5 | 78814424 | 84824816 |
| 2289 | 5 | 78814424 | 84825422 |
| 2290 | 5 | 78814424 | 84825763 |
| 2291 | 5 | 78814424 | 84825942 |
| 2292 | 5 | 78814424 | 84843411 |
| 2293 | 5 | 78814424 | 84936441 |
| 2294 | 5 | 78814424 | 84936493 |
| 2295 | 5 | 78814424 | 84943705 |
| 2296 | 5 | 78814424 | 169454950 |
| 2297 | 5 | 78814424 | 181522829 |
| 2298 | 5 | 78814424 | 204759879 |
| 2299 | 5 | 78814424 | 209874191 |
| 2300 | 5 | 78819803 | 78821393 |
| 2301 | 5 | 78819803 | 78826528 |
| 2302 | 5 | 78819803 | 78826538 |
| 2303 | 5 | 78819803 | 78826612 |
| 2304 | 5 | 78819803 | 78918620 |
| 2305 | 5 | 78819803 | 78918850 |
| 2306 | 5 | 78819803 | 79056960 |
| 2307 | 5 | 78819803 | 79163631 |
| 2308 | 5 | 78819803 | 79176557 |
| 2309 | 5 | 78819803 | 79188028 |
| 2310 | 5 | 78819803 | 79201760 |
| 2311 | 5 | 78819803 | 79230005 |
| 2312 | 5 | 78819803 | 79230318 |
| 2313 | 5 | 78819803 | 79505592 |
| 2314 | 5 | 78819803 | 79510072 |
| 2315 | 5 | 78819803 | 79538012 |
| 2316 | 5 | 78819803 | 79538048 |
| 2317 | 5 | 78819803 | 79538367 |
| 2318 | 5 | 78819803 | 79669824 |
| 2319 | 5 | 78819803 | 79682242 |
| 2320 | 5 | 78819803 | 79699261 |
| 2321 | 5 | 78819803 | 79710673 |
| 2322 | 5 | 78819803 | 79861902 |
| 2323 | 5 | 78819803 | 79867710 |
| 2324 | 5 | 78819803 | 79867868 |
| 2325 | 5 | 78819803 | 79867873 |
| 2326 | 5 | 78819803 | 79961961 |
| 2327 | 5 | 78819803 | 80086268 |
| 2328 | 5 | 78819803 | 80190673 |
| 2329 | 5 | 78819803 | 80190777 |
| 2330 | 5 | 78819803 | 80192546 |
| 2331 | 5 | 78819803 | 80195395 |
| 2332 | 5 | 78819803 | 80199923 |
| 2333 | 5 | 78819803 | 80241911 |
| 2334 | 5 | 78819803 | 80282785 |
| 2335 | 5 | 78819803 | 80345337 |
| 2336 | 5 | 78819803 | 80389787 |
| 2337 | 5 | 78819803 | 80411639 |
| 2338 | 5 | 78819803 | 80446855 |
| 2339 | 5 | 78819803 | 80492790 |
| 2340 | 5 | 78819803 | 80670554 |
| 2341 | 5 | 78819803 | 80674679 |
| 2342 | 5 | 78819803 | 80720509 |
| 2343 | 5 | 78819803 | 80800856 |
| 2344 | 5 | 78819803 | 80804587 |
| 2345 | 5 | 78819803 | 80807409 |
| 2346 | 5 | 78819803 | 80835734 |
| 2347 | 5 | 78819803 | 80971764 |
| 2348 | 5 | 78819803 | 80972258 |
| 2349 | 5 | 78819803 | 80974450 |
| 2350 | 5 | 78819803 | 81047638 |
| 2351 | 5 | 78819803 | 81082921 |
| 2352 | 5 | 78819803 | 81157909 |
| 2353 | 5 | 78819803 | 81265937 |
| 2354 | 5 | 78819803 | 81265937 |
| 2355 | 5 | 78819803 | 81267485 |
| 2356 | 5 | 78819803 | 81267499 |
| 2357 | 5 | 78819803 | 81274512 |
| 2358 | 5 | 78819803 | 81763618 |
| 2359 | 5 | 78819803 | 81797217 |
| 2360 | 5 | 78819803 | 81800186 |
| 2361 | 5 | 78819803 | 81806213 |
| 2362 | 5 | 78819803 | 81854583 |
| 2363 | 5 | 78819803 | 81859374 |
| 2364 | 5 | 78819803 | 81861368 |
| 2365 | 5 | 78819803 | 81863686 |
| 2366 | 5 | 78819803 | 81916850 |
| 2367 | 5 | 78819803 | 81954891 |
| 2368 | 5 | 78819803 | 81985250 |
| 2369 | 5 | 78819803 | 82083752 |
| 2370 | 5 | 78819803 | 82101253 |
| 2371 | 5 | 78819803 | 82143124 |
| 2372 | 5 | 78819803 | 82236318 |
| 2373 | 5 | 78819803 | 82325587 |
| 2374 | 5 | 78819803 | 82427210 |
| 2375 | 5 | 78819803 | 82431853 |
| 2376 | 5 | 78819803 | 82446714 |
| 2377 | 5 | 78819803 | 82446794 |
| 2378 | 5 | 78819803 | 82551111 |
| 2379 | 5 | 78819803 | 82552090 |
| 2380 | 5 | 78819803 | 82555641 |
| 2381 | 5 | 78819803 | 82555670 |
| 2382 | 5 | 78819803 | 82556511 |
| 2383 | 5 | 78819803 | 82559047 |
| 2384 | 5 | 78819803 | 82561535 |
| 2385 | 5 | 78819803 | 82610100 |
| 2386 | 5 | 78819803 | 82676822 |
| 2387 | 5 | 78819803 | 82676901 |
| 2388 | 5 | 78819803 | 82883691 |
| 2389 | 5 | 78819803 | 82954942 |
| 2390 | 5 | 78819803 | 82971688 |
| 2391 | 5 | 78819803 | 83023965 |
| 2392 | 5 | 78819803 | 83094205 |
| 2393 | 5 | 78819803 | 83146355 |
| 2394 | 5 | 78819803 | 83280630 |
| 2395 | 5 | 78819803 | 83281412 |
| 2396 | 5 | 78819803 | 83400242 |
| 2397 | 5 | 78819803 | 83405797 |
| 2398 | 5 | 78819803 | 83437132 |
| 2399 | 5 | 78819803 | 83522252 |
| 2400 | 5 | 78819803 | 83560095 |
| 2401 | 5 | 78819803 | 83560204 |
| 2402 | 5 | 78819803 | 83572400 |
| 2403 | 5 | 78819803 | 83607661 |
| 2404 | 5 | 78819803 | 83745342 |
| 2405 | 5 | 78819803 | 83861275 |
| 2406 | 5 | 78819803 | 83861633 |
| 2407 | 5 | 78819803 | 83865653 |
| 2408 | 5 | 78819803 | 83865914 |
| 2409 | 5 | 78819803 | 83865920 |
| 2410 | 5 | 78819803 | 83868010 |
| 2411 | 5 | 78819803 | 84019752 |
| 2412 | 5 | 78819803 | 84065912 |
| 2413 | 5 | 78819803 | 84086632 |
| 2414 | 5 | 78819803 | 84089603 |
| 2415 | 5 | 78819803 | 84104814 |
| 2416 | 5 | 78819803 | 84105175 |
| 2417 | 5 | 78819803 | 84251635 |
| 2418 | 5 | 78819803 | 84252180 |

TABLE 1-continued

Examples of chromosomal segments associated with increased fertility in maize.

| Chromosomal Segment | Chr. | Boundary 1 | Boundary 2 |
|---|---|---|---|
| 2419 | 5 | 78819803 | 84253030 |
| 2420 | 5 | 78819803 | 84254208 |
| 2421 | 5 | 78819803 | 84314930 |
| 2422 | 5 | 78819803 | 84340523 |
| 2423 | 5 | 78819803 | 84516340 |
| 2424 | 5 | 78819803 | 84706916 |
| 2425 | 5 | 78819803 | 84799488 |
| 2426 | 5 | 78819803 | 84801081 |
| 2427 | 5 | 78819803 | 84824103 |
| 2428 | 5 | 78819803 | 84824203 |
| 2429 | 5 | 78819803 | 84824816 |
| 2430 | 5 | 78819803 | 84825422 |
| 2431 | 5 | 78819803 | 84825763 |
| 2432 | 5 | 78819803 | 84825942 |
| 2433 | 5 | 78819803 | 84843411 |
| 2434 | 5 | 78819803 | 84936441 |
| 2435 | 5 | 78819803 | 84936493 |
| 2436 | 5 | 78819803 | 84943705 |
| 2437 | 5 | 78819803 | 169454950 |
| 2438 | 5 | 78819803 | 181522829 |
| 2439 | 5 | 78819803 | 204759879 |
| 2440 | 5 | 78819803 | 209874191 |
| 2441 | 5 | 78821393 | 78826528 |
| 2442 | 5 | 78820119 | 78826528 |
| 2443 | 5 | 78820119 | 78826538 |
| 2444 | 5 | 78820119 | 78826612 |
| 2445 | 5 | 78820119 | 78918620 |
| 2446 | 5 | 78820119 | 78918850 |
| 2447 | 5 | 78820119 | 79056960 |
| 2448 | 5 | 78820119 | 79163631 |
| 2449 | 5 | 78820119 | 79176557 |
| 2450 | 5 | 78820119 | 79188028 |
| 2451 | 5 | 78820119 | 79201760 |
| 2452 | 5 | 78820119 | 79230005 |
| 2453 | 5 | 78820119 | 79230318 |
| 2454 | 5 | 78820119 | 79505592 |
| 2455 | 5 | 78820119 | 79510072 |
| 2456 | 5 | 78820119 | 79538012 |
| 2457 | 5 | 78820119 | 79538048 |
| 2458 | 5 | 78820119 | 79538367 |
| 2459 | 5 | 78820119 | 79669824 |
| 2460 | 5 | 78820119 | 79682242 |
| 2461 | 5 | 78820119 | 79699261 |
| 2462 | 5 | 78820119 | 79710673 |
| 2463 | 5 | 78820119 | 79861902 |
| 2464 | 5 | 78820119 | 79867710 |
| 2465 | 5 | 78820119 | 79867868 |
| 2466 | 5 | 78820119 | 79867873 |
| 2467 | 5 | 78820119 | 79961961 |
| 2468 | 5 | 78820119 | 80086268 |
| 2469 | 5 | 78820119 | 80190673 |
| 2470 | 5 | 78820119 | 80190777 |
| 2471 | 5 | 78820119 | 80192546 |
| 2472 | 5 | 78820119 | 80195395 |
| 2473 | 5 | 78820119 | 80199923 |
| 2474 | 5 | 78820119 | 80241911 |
| 2475 | 5 | 78820119 | 80282785 |
| 2476 | 5 | 78820119 | 80345337 |
| 2477 | 5 | 78820119 | 80389787 |
| 2478 | 5 | 78820119 | 80411639 |
| 2479 | 5 | 78820119 | 80446855 |
| 2480 | 5 | 78820119 | 80492790 |
| 2481 | 5 | 78820119 | 80670554 |
| 2482 | 5 | 78820119 | 80674679 |
| 2483 | 5 | 78820119 | 80720509 |
| 2484 | 5 | 78820119 | 80800856 |
| 2485 | 5 | 78820119 | 80804587 |
| 2486 | 5 | 78820119 | 80807409 |
| 2487 | 5 | 78820119 | 80835734 |
| 2488 | 5 | 78820119 | 80971764 |
| 2489 | 5 | 78820119 | 80972258 |
| 2490 | 5 | 78820119 | 80974450 |
| 2491 | 5 | 78820119 | 81047638 |
| 2492 | 5 | 78820119 | 81082921 |
| 2493 | 5 | 78820119 | 81157909 |
| 2494 | 5 | 78820119 | 81265937 |
| 2495 | 5 | 78820119 | 81265937 |
| 2496 | 5 | 78820119 | 81267485 |
| 2497 | 5 | 78820119 | 81267499 |
| 2498 | 5 | 78820119 | 81274512 |
| 2499 | 5 | 78820119 | 81763618 |
| 2500 | 5 | 78820119 | 81797217 |
| 2501 | 5 | 78820119 | 81800186 |
| 2502 | 5 | 78820119 | 81806213 |
| 2503 | 5 | 78820119 | 81854583 |
| 2504 | 5 | 78820119 | 81859374 |
| 2505 | 5 | 78820119 | 81861368 |
| 2506 | 5 | 78820119 | 81863686 |
| 2507 | 5 | 78820119 | 81916850 |
| 2508 | 5 | 78820119 | 81954891 |
| 2509 | 5 | 78820119 | 81985250 |
| 2510 | 5 | 78820119 | 82083752 |
| 2511 | 5 | 78820119 | 82101253 |
| 2512 | 5 | 78820119 | 82143124 |
| 2513 | 5 | 78820119 | 82236318 |
| 2514 | 5 | 78820119 | 82325587 |
| 2515 | 5 | 78820119 | 82427210 |
| 2516 | 5 | 78820119 | 82431853 |
| 2517 | 5 | 78820119 | 82446714 |
| 2518 | 5 | 78820119 | 82446794 |
| 2519 | 5 | 78820119 | 82551111 |
| 2520 | 5 | 78820119 | 82552090 |
| 2521 | 5 | 78820119 | 82555641 |
| 2522 | 5 | 78820119 | 82555670 |
| 2523 | 5 | 78820119 | 82556511 |
| 2524 | 5 | 78820119 | 82559047 |
| 2525 | 5 | 78820119 | 82561535 |
| 2526 | 5 | 78820119 | 82610100 |
| 2527 | 5 | 78820119 | 82676822 |
| 2528 | 5 | 78820119 | 82676901 |
| 2529 | 5 | 78820119 | 82883691 |
| 2530 | 5 | 78820119 | 82954942 |
| 2531 | 5 | 78820119 | 82971688 |
| 2532 | 5 | 78820119 | 83023965 |
| 2533 | 5 | 78820119 | 83094205 |
| 2534 | 5 | 78820119 | 83146355 |
| 2535 | 5 | 78820119 | 83280630 |
| 2536 | 5 | 78820119 | 83281412 |
| 2537 | 5 | 78820119 | 83400242 |
| 2538 | 5 | 78820119 | 83405797 |
| 2539 | 5 | 78820119 | 83437132 |
| 2540 | 5 | 78820119 | 83522252 |
| 2541 | 5 | 78820119 | 83560095 |
| 2542 | 5 | 78820119 | 83560204 |
| 2543 | 5 | 78820119 | 83572400 |
| 2544 | 5 | 78820119 | 83607661 |
| 2545 | 5 | 78820119 | 83745342 |
| 2546 | 5 | 78820119 | 83861275 |
| 2547 | 5 | 78820119 | 83861633 |
| 2548 | 5 | 78820119 | 83865653 |
| 2549 | 5 | 78820119 | 83865914 |
| 2550 | 5 | 78820119 | 83865920 |
| 2551 | 5 | 78820119 | 83868010 |
| 2552 | 5 | 78820119 | 84019752 |
| 2553 | 5 | 78820119 | 84065912 |
| 2554 | 5 | 78820119 | 84086632 |
| 2555 | 5 | 78820119 | 84089603 |
| 2556 | 5 | 78820119 | 84104814 |
| 2557 | 5 | 78820119 | 84105175 |
| 2558 | 5 | 78820119 | 84251635 |
| 2559 | 5 | 78820119 | 84252180 |
| 2560 | 5 | 78820119 | 84253030 |
| 2561 | 5 | 78820119 | 84254208 |
| 2562 | 5 | 78820119 | 84314930 |
| 2563 | 5 | 78820119 | 84340523 |
| 2564 | 5 | 78820119 | 84516340 |
| 2565 | 5 | 78820119 | 84706916 |
| 2566 | 5 | 78820119 | 84799488 |

TABLE 1-continued

Examples of chromosomal segments associated with increased fertility in maize.

| Chromosomal Segment | Chr. | Boundary 1 | Boundary 2 |
|---|---|---|---|
| 2567 | 5 | 78820119 | 84801081 |
| 2568 | 5 | 78820119 | 84824103 |
| 2569 | 5 | 78820119 | 84824203 |
| 2570 | 5 | 78820119 | 84824816 |
| 2571 | 5 | 78820119 | 84825422 |
| 2572 | 5 | 78820119 | 84825763 |
| 2573 | 5 | 78820119 | 84825942 |
| 2574 | 5 | 78820119 | 84843411 |
| 2575 | 5 | 78820119 | 84936441 |
| 2576 | 5 | 78820119 | 84936493 |
| 2577 | 5 | 78820119 | 84943705 |
| 2578 | 5 | 78820119 | 169454950 |
| 2579 | 5 | 78820119 | 181522829 |
| 2580 | 5 | 78820119 | 204759879 |
| 2581 | 5 | 78820119 | 209874191 |
| 2582 | 5 | 78904639 | 78918620 |
| 2583 | 5 | 78904639 | 78918850 |
| 2584 | 5 | 78904639 | 79056960 |
| 2585 | 5 | 78904639 | 79163631 |
| 2586 | 5 | 78904639 | 79176557 |
| 2587 | 5 | 78904639 | 79188028 |
| 2588 | 5 | 78904639 | 79201760 |
| 2589 | 5 | 78904639 | 79230005 |
| 2590 | 5 | 78904639 | 79230318 |
| 2591 | 5 | 78904639 | 79505592 |
| 2592 | 5 | 78904639 | 79510072 |
| 2593 | 5 | 78904639 | 79538012 |
| 2594 | 5 | 78904639 | 79538048 |
| 2595 | 5 | 78904639 | 79538367 |
| 2596 | 5 | 78904639 | 79669824 |
| 2597 | 5 | 78904639 | 79682242 |
| 2598 | 5 | 78904639 | 79699261 |
| 2599 | 5 | 78904639 | 79710673 |
| 2600 | 5 | 78904639 | 79861902 |
| 2601 | 5 | 78904639 | 79867710 |
| 2602 | 5 | 78904639 | 79867868 |
| 2603 | 5 | 78904639 | 79867873 |
| 2604 | 5 | 78904639 | 79961961 |
| 2605 | 5 | 78904639 | 80086268 |
| 2606 | 5 | 78904639 | 80190673 |
| 2607 | 5 | 78904639 | 80190777 |
| 2608 | 5 | 78904639 | 80192546 |
| 2609 | 5 | 78904639 | 80195395 |
| 2610 | 5 | 78904639 | 80199923 |
| 2611 | 5 | 78904639 | 80241911 |
| 2612 | 5 | 78904639 | 80282785 |
| 2613 | 5 | 78904639 | 80345337 |
| 2614 | 5 | 78904639 | 80389787 |
| 2615 | 5 | 78904639 | 80411639 |
| 2616 | 5 | 78904639 | 80446855 |
| 2617 | 5 | 78904639 | 80492790 |
| 2618 | 5 | 78904639 | 80670554 |
| 2619 | 5 | 78904639 | 80674679 |
| 2620 | 5 | 78904639 | 80720509 |
| 2621 | 5 | 78904639 | 80800856 |
| 2622 | 5 | 78904639 | 80804587 |
| 2623 | 5 | 78904639 | 80807409 |
| 2624 | 5 | 78904639 | 80835734 |
| 2625 | 5 | 78904639 | 80971764 |
| 2626 | 5 | 78904639 | 80972258 |
| 2627 | 5 | 78904639 | 80974450 |
| 2628 | 5 | 78904639 | 81047638 |
| 2629 | 5 | 78904639 | 81082921 |
| 2630 | 5 | 78904639 | 81157909 |
| 2631 | 5 | 78904639 | 81265937 |
| 2632 | 5 | 78904639 | 81265937 |
| 2633 | 5 | 78904639 | 81267485 |
| 2634 | 5 | 78904639 | 81267499 |
| 2635 | 5 | 78904639 | 81274512 |
| 2636 | 5 | 78904639 | 81763618 |
| 2637 | 5 | 78904639 | 81797217 |
| 2638 | 5 | 78904639 | 81800186 |
| 2639 | 5 | 78904639 | 81806213 |
| 2640 | 5 | 78904639 | 81854583 |
| 2641 | 5 | 78904639 | 81859374 |
| 2642 | 5 | 78904639 | 81861368 |
| 2643 | 5 | 78904639 | 81863686 |
| 2644 | 5 | 78904639 | 81916850 |
| 2645 | 5 | 78904639 | 81954891 |
| 2646 | 5 | 78904639 | 81985250 |
| 2647 | 5 | 78904639 | 82083752 |
| 2648 | 5 | 78904639 | 82101253 |
| 2649 | 5 | 78904639 | 82143124 |
| 2650 | 5 | 78904639 | 82236318 |
| 2651 | 5 | 78904639 | 82325587 |
| 2652 | 5 | 78904639 | 82427210 |
| 2653 | 5 | 78904639 | 82431853 |
| 2654 | 5 | 78904639 | 82446714 |
| 2655 | 5 | 78904639 | 82446794 |
| 2656 | 5 | 78904639 | 82551111 |
| 2657 | 5 | 78904639 | 82552090 |
| 2658 | 5 | 78904639 | 82555641 |
| 2659 | 5 | 78904639 | 82555670 |
| 2660 | 5 | 78904639 | 82556511 |
| 2661 | 5 | 78904639 | 82559047 |
| 2662 | 5 | 78904639 | 82561535 |
| 2663 | 5 | 78904639 | 82610100 |
| 2664 | 5 | 78904639 | 82676822 |
| 2665 | 5 | 78904639 | 82676901 |
| 2666 | 5 | 78904639 | 82883691 |
| 2667 | 5 | 78904639 | 82954942 |
| 2668 | 5 | 78904639 | 82971688 |
| 2669 | 5 | 78904639 | 83023965 |
| 2670 | 5 | 78904639 | 83094205 |
| 2671 | 5 | 78904639 | 83146355 |
| 2672 | 5 | 78904639 | 83280630 |
| 2673 | 5 | 78904639 | 83281412 |
| 2674 | 5 | 78904639 | 83400242 |
| 2675 | 5 | 78904639 | 83405797 |
| 2676 | 5 | 78904639 | 83437132 |
| 2677 | 5 | 78904639 | 83522252 |
| 2678 | 5 | 78904639 | 83560095 |
| 2679 | 5 | 78904639 | 83560204 |
| 2680 | 5 | 78904639 | 83572400 |
| 2681 | 5 | 78904639 | 83607661 |
| 2682 | 5 | 78904639 | 83745342 |
| 2683 | 5 | 78904639 | 83861275 |
| 2684 | 5 | 78904639 | 83861633 |
| 2685 | 5 | 78904639 | 83865653 |
| 2686 | 5 | 78904639 | 83865914 |
| 2687 | 5 | 78904639 | 83865920 |
| 2688 | 5 | 78904639 | 83868010 |
| 2689 | 5 | 78904639 | 84019752 |
| 2690 | 5 | 78904639 | 84065912 |
| 2691 | 5 | 78904639 | 84086632 |
| 2692 | 5 | 78904639 | 84089603 |
| 2693 | 5 | 78904639 | 84104814 |
| 2694 | 5 | 78904639 | 84105175 |
| 2695 | 5 | 78904639 | 84251635 |
| 2696 | 5 | 78904639 | 84252180 |
| 2697 | 5 | 78904639 | 84253030 |
| 2698 | 5 | 78904639 | 84254208 |
| 2699 | 5 | 78904639 | 84314930 |
| 2700 | 5 | 78904639 | 84340523 |
| 2701 | 5 | 78904639 | 84516340 |
| 2702 | 5 | 78904639 | 84706916 |
| 2703 | 5 | 78904639 | 84799488 |
| 2704 | 5 | 78904639 | 84801081 |
| 2705 | 5 | 78904639 | 84824103 |
| 2706 | 5 | 78904639 | 84824203 |
| 2707 | 5 | 78904639 | 84824816 |
| 2708 | 5 | 78904639 | 84825422 |
| 2709 | 5 | 78904639 | 84825763 |
| 2710 | 5 | 78904639 | 84825942 |
| 2711 | 5 | 78904639 | 84843411 |
| 2712 | 5 | 78904639 | 84936441 |
| 2713 | 5 | 78904639 | 84936493 |
| 2714 | 5 | 78904639 | 84943705 |

TABLE 1-continued

Examples of chromosomal segments associated with increased fertility in maize.

| Chromosomal Segment | Chr. | Boundary 1 | Boundary 2 |
| --- | --- | --- | --- |
| 2715 | 5 | 78904639 | 169454950 |
| 2716 | 5 | 78904639 | 181522829 |
| 2717 | 5 | 78904639 | 204759879 |
| 2718 | 5 | 78904639 | 209874191 |
| 2719 | 5 | 78918620 | 78918850 |
| 2720 | 5 | 78918620 | 79056960 |
| 2721 | 5 | 78918620 | 79163631 |
| 2722 | 5 | 78918620 | 79176557 |
| 2723 | 5 | 78918620 | 79188028 |
| 2724 | 5 | 78918620 | 79201760 |
| 2725 | 5 | 78918620 | 79230005 |
| 2726 | 5 | 78918620 | 79230318 |
| 2727 | 5 | 78918620 | 79505592 |
| 2728 | 5 | 78918620 | 79510072 |
| 2729 | 5 | 78918620 | 79538012 |
| 2730 | 5 | 78918620 | 79538048 |
| 2731 | 5 | 78918620 | 79538367 |
| 2732 | 5 | 78918620 | 79669824 |
| 2733 | 5 | 78918620 | 79682242 |
| 2734 | 5 | 78918620 | 79699261 |
| 2735 | 5 | 78918620 | 79710673 |
| 2736 | 5 | 78918620 | 79861902 |
| 2737 | 5 | 78918620 | 79867710 |
| 2738 | 5 | 78918620 | 79867868 |
| 2739 | 5 | 78918620 | 79867873 |
| 2740 | 5 | 78918620 | 79961961 |
| 2741 | 5 | 78918620 | 80086268 |
| 2742 | 5 | 78918620 | 80190673 |
| 2743 | 5 | 78918620 | 80190777 |
| 2744 | 5 | 78918620 | 80192546 |
| 2745 | 5 | 78918620 | 80195395 |
| 2746 | 5 | 78918620 | 80199923 |
| 2747 | 5 | 78918620 | 80241911 |
| 2748 | 5 | 78918620 | 80282785 |
| 2749 | 5 | 78918620 | 80345337 |
| 2750 | 5 | 78918620 | 80389787 |
| 2751 | 5 | 78918620 | 80411639 |
| 2752 | 5 | 78918620 | 80446855 |
| 2753 | 5 | 78918620 | 80492790 |
| 2754 | 5 | 78918620 | 80670554 |
| 2755 | 5 | 78918620 | 80674679 |
| 2756 | 5 | 78918620 | 80720509 |
| 2757 | 5 | 78918620 | 80800856 |
| 2758 | 5 | 78918620 | 80804587 |
| 2759 | 5 | 78918620 | 80807409 |
| 2760 | 5 | 78918620 | 80835734 |
| 2761 | 5 | 78918620 | 80971764 |
| 2762 | 5 | 78918620 | 80972258 |
| 2763 | 5 | 78918620 | 80974450 |
| 2764 | 5 | 78918620 | 81047638 |
| 2765 | 5 | 78918620 | 81082921 |
| 2766 | 5 | 78918620 | 81157909 |
| 2767 | 5 | 78918620 | 81265937 |
| 2768 | 5 | 78918620 | 81265937 |
| 2769 | 5 | 78918620 | 81267485 |
| 2770 | 5 | 78918620 | 81267499 |
| 2771 | 5 | 78918620 | 81274512 |
| 2772 | 5 | 78918620 | 81763618 |
| 2773 | 5 | 78918620 | 81797217 |
| 2774 | 5 | 78918620 | 81800186 |
| 2775 | 5 | 78918620 | 81806213 |
| 2776 | 5 | 78918620 | 81854583 |
| 2777 | 5 | 78918620 | 81859374 |
| 2778 | 5 | 78918620 | 81861368 |
| 2779 | 5 | 78918620 | 81863686 |
| 2780 | 5 | 78918620 | 81916850 |
| 2781 | 5 | 78918620 | 81954891 |
| 2782 | 5 | 78918620 | 81985250 |
| 2783 | 5 | 78918620 | 82083752 |
| 2784 | 5 | 78918620 | 82101253 |
| 2785 | 5 | 78918620 | 82143124 |
| 2786 | 5 | 78918620 | 82236318 |
| 2787 | 5 | 78918620 | 82325587 |
| 2788 | 5 | 78918620 | 82427210 |
| 2789 | 5 | 78918620 | 82431853 |
| 2790 | 5 | 78918620 | 82446714 |
| 2791 | 5 | 78918620 | 82446794 |
| 2792 | 5 | 78918620 | 82551111 |
| 2793 | 5 | 78918620 | 82552090 |
| 2794 | 5 | 78918620 | 82555641 |
| 2795 | 5 | 78918620 | 82555670 |
| 2796 | 5 | 78918620 | 82556511 |
| 2797 | 5 | 78918620 | 82559047 |
| 2798 | 5 | 78918620 | 82561535 |
| 2799 | 5 | 78918620 | 82610100 |
| 2800 | 5 | 78918620 | 82676822 |
| 2801 | 5 | 78918620 | 82676901 |
| 2802 | 5 | 78918620 | 82883691 |
| 2803 | 5 | 78918620 | 82954942 |
| 2804 | 5 | 78918620 | 82971688 |
| 2805 | 5 | 78918620 | 83023965 |
| 2806 | 5 | 78918620 | 83094205 |
| 2807 | 5 | 78918620 | 83146355 |
| 2808 | 5 | 78918620 | 83280630 |
| 2809 | 5 | 78918620 | 83281412 |
| 2810 | 5 | 78918620 | 83400242 |
| 2811 | 5 | 78918620 | 83405797 |
| 2812 | 5 | 78918620 | 83437132 |
| 2813 | 5 | 78918620 | 83522252 |
| 2814 | 5 | 78918620 | 83560095 |
| 2815 | 5 | 78918620 | 83560204 |
| 2816 | 5 | 78918620 | 83572400 |
| 2817 | 5 | 78918620 | 83607661 |
| 2818 | 5 | 78918620 | 83745342 |
| 2819 | 5 | 78918620 | 83861275 |
| 2820 | 5 | 78918620 | 83861633 |
| 2821 | 5 | 78918620 | 83865653 |
| 2822 | 5 | 78918620 | 83865914 |
| 2823 | 5 | 78918620 | 83865920 |
| 2824 | 5 | 78918620 | 83868010 |
| 2825 | 5 | 78918620 | 84019752 |
| 2826 | 5 | 78918620 | 84065912 |
| 2827 | 5 | 78918620 | 84086632 |
| 2828 | 5 | 78918620 | 84089603 |
| 2829 | 5 | 78918620 | 84104814 |
| 2830 | 5 | 78918620 | 84105175 |
| 2831 | 5 | 78918620 | 84251635 |
| 2832 | 5 | 78918620 | 84252180 |
| 2833 | 5 | 78918620 | 84253030 |
| 2834 | 5 | 78918620 | 84254208 |
| 2835 | 5 | 78918620 | 84314930 |
| 2836 | 5 | 78918620 | 84340523 |
| 2837 | 5 | 78918620 | 84516340 |
| 2838 | 5 | 78918620 | 84706916 |
| 2839 | 5 | 78918620 | 84799488 |
| 2840 | 5 | 78918620 | 84801081 |
| 2841 | 5 | 78918620 | 84824103 |
| 2842 | 5 | 78918620 | 84824203 |
| 2843 | 5 | 78918620 | 84824816 |
| 2844 | 5 | 78918620 | 84825422 |
| 2845 | 5 | 78918620 | 84825763 |
| 2846 | 5 | 78918620 | 84825942 |
| 2847 | 5 | 78918620 | 84843411 |
| 2848 | 5 | 78918620 | 84936441 |
| 2849 | 5 | 78918620 | 84936493 |
| 2850 | 5 | 78918620 | 84943705 |
| 2851 | 5 | 78918620 | 169454950 |
| 2852 | 5 | 78918620 | 181522829 |
| 2853 | 5 | 78918620 | 204759879 |
| 2854 | 5 | 78918620 | 209874191 |
| 2855 | 5 | 79055654 | 78918620 |
| 2856 | 5 | 79055654 | 79056960 |
| 2857 | 5 | 79055654 | 79163631 |
| 2858 | 5 | 79055654 | 79176557 |
| 2859 | 5 | 79055654 | 79188028 |
| 2860 | 5 | 79055654 | 79201760 |
| 2861 | 5 | 79055654 | 79230005 |
| 2862 | 5 | 79055654 | 79230318 |

TABLE 1-continued

Examples of chromosomal segments associated with increased fertility in maize.

| Chromosomal Segment | Chr. | Boundary 1 | Boundary 2 |
|---|---|---|---|
| 2863 | 5 | 79055654 | 79505592 |
| 2864 | 5 | 79055654 | 79510072 |
| 2865 | 5 | 79055654 | 79538012 |
| 2866 | 5 | 79055654 | 79538048 |
| 2867 | 5 | 79055654 | 79538367 |
| 2868 | 5 | 79055654 | 79669824 |
| 2869 | 5 | 79055654 | 79682242 |
| 2870 | 5 | 79055654 | 79699261 |
| 2871 | 5 | 79055654 | 79710673 |
| 2872 | 5 | 79055654 | 79861902 |
| 2873 | 5 | 79055654 | 79867710 |
| 2874 | 5 | 79055654 | 79867868 |
| 2875 | 5 | 79055654 | 79867873 |
| 2876 | 5 | 79055654 | 79961961 |
| 2877 | 5 | 79055654 | 80086268 |
| 2878 | 5 | 79055654 | 80190673 |
| 2879 | 5 | 79055654 | 80190777 |
| 2880 | 5 | 79055654 | 80192546 |
| 2881 | 5 | 79055654 | 80195395 |
| 2882 | 5 | 79055654 | 80199923 |
| 2883 | 5 | 79055654 | 80241911 |
| 2884 | 5 | 79055654 | 80282785 |
| 2885 | 5 | 79055654 | 80345337 |
| 2886 | 5 | 79055654 | 80389787 |
| 2887 | 5 | 79055654 | 80411639 |
| 2888 | 5 | 79055654 | 80446855 |
| 2889 | 5 | 79055654 | 80492790 |
| 2890 | 5 | 79055654 | 80670554 |
| 2891 | 5 | 79055654 | 80674679 |
| 2892 | 5 | 79055654 | 80720509 |
| 2893 | 5 | 79055654 | 80800856 |
| 2894 | 5 | 79055654 | 80804587 |
| 2895 | 5 | 79055654 | 80807409 |
| 2896 | 5 | 79055654 | 80835734 |
| 2897 | 5 | 79055654 | 80971764 |
| 2898 | 5 | 79055654 | 80972258 |
| 2899 | 5 | 79055654 | 80974450 |
| 2900 | 5 | 79055654 | 81047638 |
| 2901 | 5 | 79055654 | 81082921 |
| 2902 | 5 | 79055654 | 81157909 |
| 2903 | 5 | 79055654 | 81265937 |
| 2904 | 5 | 79055654 | 81265937 |
| 2905 | 5 | 79055654 | 81267485 |
| 2906 | 5 | 79055654 | 81267499 |
| 2907 | 5 | 79055654 | 81274512 |
| 2908 | 5 | 79055654 | 81763618 |
| 2909 | 5 | 79055654 | 81797217 |
| 2910 | 5 | 79055654 | 81800186 |
| 2911 | 5 | 79055654 | 81806213 |
| 2912 | 5 | 79055654 | 81854583 |
| 2913 | 5 | 79055654 | 81859374 |
| 2914 | 5 | 79055654 | 81861368 |
| 2915 | 5 | 79055654 | 81863686 |
| 2916 | 5 | 79055654 | 81916850 |
| 2917 | 5 | 79055654 | 81954891 |
| 2918 | 5 | 79055654 | 81985250 |
| 2919 | 5 | 79055654 | 82083752 |
| 2920 | 5 | 79055654 | 82101253 |
| 2921 | 5 | 79055654 | 82143124 |
| 2922 | 5 | 79055654 | 82236318 |
| 2923 | 5 | 79055654 | 82325587 |
| 2924 | 5 | 79055654 | 82427210 |
| 2925 | 5 | 79055654 | 82431853 |
| 2926 | 5 | 79055654 | 82446714 |
| 2927 | 5 | 79055654 | 82446794 |
| 2928 | 5 | 79055654 | 82551111 |
| 2929 | 5 | 79055654 | 82552090 |
| 2930 | 5 | 79055654 | 82555641 |
| 2931 | 5 | 79055654 | 82555670 |
| 2932 | 5 | 79055654 | 82556511 |
| 2933 | 5 | 79055654 | 82559047 |
| 2934 | 5 | 79055654 | 82561535 |
| 2935 | 5 | 79055654 | 82610100 |
| 2936 | 5 | 79055654 | 82676822 |
| 2937 | 5 | 79055654 | 82676901 |
| 2938 | 5 | 79055654 | 82883691 |
| 2939 | 5 | 79055654 | 82954942 |
| 2940 | 5 | 79055654 | 82971688 |
| 2941 | 5 | 79055654 | 83023965 |
| 2942 | 5 | 79055654 | 83094205 |
| 2943 | 5 | 79055654 | 83146355 |
| 2944 | 5 | 79055654 | 83280630 |
| 2945 | 5 | 79055654 | 83281412 |
| 2946 | 5 | 79055654 | 83400242 |
| 2947 | 5 | 79055654 | 83405797 |
| 2948 | 5 | 79055654 | 83437132 |
| 2949 | 5 | 79055654 | 83522252 |
| 2950 | 5 | 79055654 | 83560095 |
| 2951 | 5 | 79055654 | 83560204 |
| 2952 | 5 | 79055654 | 83572400 |
| 2953 | 5 | 79055654 | 83607661 |
| 2954 | 5 | 79055654 | 83745342 |
| 2955 | 5 | 79055654 | 83861275 |
| 2956 | 5 | 79055654 | 83861633 |
| 2957 | 5 | 79055654 | 83865653 |
| 2958 | 5 | 79055654 | 83865914 |
| 2959 | 5 | 79055654 | 83865920 |
| 2960 | 5 | 79055654 | 83868010 |
| 2961 | 5 | 79055654 | 84019752 |
| 2962 | 5 | 79055654 | 84065912 |
| 2963 | 5 | 79055654 | 84086632 |
| 2964 | 5 | 79055654 | 84089603 |
| 2965 | 5 | 79055654 | 84104814 |
| 2966 | 5 | 79055654 | 84105175 |
| 2967 | 5 | 79055654 | 84251635 |
| 2968 | 5 | 79055654 | 84252180 |
| 2969 | 5 | 79055654 | 84253030 |
| 2970 | 5 | 79055654 | 84254208 |
| 2971 | 5 | 79055654 | 84314930 |
| 2972 | 5 | 79055654 | 84340523 |
| 2973 | 5 | 79055654 | 84516340 |
| 2974 | 5 | 79055654 | 84706916 |
| 2975 | 5 | 79055654 | 84799488 |
| 2976 | 5 | 79055654 | 84801081 |
| 2977 | 5 | 79055654 | 84824103 |
| 2978 | 5 | 79055654 | 84824203 |
| 2979 | 5 | 79055654 | 84824816 |
| 2980 | 5 | 79055654 | 84825422 |
| 2981 | 5 | 79055654 | 84825763 |
| 2982 | 5 | 79055654 | 84825942 |
| 2983 | 5 | 79055654 | 84843411 |
| 2984 | 5 | 79055654 | 84936441 |
| 2985 | 5 | 79055654 | 84936493 |
| 2986 | 5 | 79055654 | 84943705 |
| 2987 | 5 | 79055654 | 169454950 |
| 2988 | 5 | 79055654 | 181522829 |
| 2989 | 5 | 79055654 | 204759879 |
| 2990 | 5 | 79055654 | 209874191 |
| 2991 | 5 | 79162381 | 79163631 |
| 2992 | 5 | 79162381 | 79176557 |
| 2993 | 5 | 79162381 | 79188028 |
| 2994 | 5 | 79162381 | 79201760 |
| 2995 | 5 | 79162381 | 79230005 |
| 2996 | 5 | 79162381 | 79230318 |
| 2997 | 5 | 79162381 | 79505592 |
| 2998 | 5 | 79162381 | 79510072 |
| 2999 | 5 | 79162381 | 79538012 |
| 3000 | 5 | 79162381 | 79538048 |
| 3001 | 5 | 79162381 | 79538367 |
| 3002 | 5 | 79162381 | 79669824 |
| 3003 | 5 | 79162381 | 79682242 |
| 3004 | 5 | 79162381 | 79699261 |
| 3005 | 5 | 79162381 | 79710673 |
| 3006 | 5 | 79162381 | 79861902 |
| 3007 | 5 | 79162381 | 79867710 |
| 3008 | 5 | 79162381 | 79867868 |
| 3009 | 5 | 79162381 | 79867873 |
| 3010 | 5 | 79162381 | 79961961 |

TABLE 1-continued

Examples of chromosomal segments associated with increased fertility in maize.

| Chromosomal Segment | Chr. | Boundary 1 | Boundary 2 |
|---|---|---|---|
| 3011 | 5 | 79162381 | 80086268 |
| 3012 | 5 | 79162381 | 80190673 |
| 3013 | 5 | 79162381 | 80190777 |
| 3014 | 5 | 79162381 | 80192546 |
| 3015 | 5 | 79162381 | 80195395 |
| 3016 | 5 | 79162381 | 80199923 |
| 3017 | 5 | 79162381 | 80241911 |
| 3018 | 5 | 79162381 | 80282785 |
| 3019 | 5 | 79162381 | 80345337 |
| 3020 | 5 | 79162381 | 80389787 |
| 3021 | 5 | 79162381 | 80411639 |
| 3022 | 5 | 79162381 | 80446855 |
| 3023 | 5 | 79162381 | 80492790 |
| 3024 | 5 | 79162381 | 80670554 |
| 3025 | 5 | 79162381 | 80674679 |
| 3026 | 5 | 79162381 | 80720509 |
| 3027 | 5 | 79162381 | 80800856 |
| 3028 | 5 | 79162381 | 80804587 |
| 3029 | 5 | 79162381 | 80807409 |
| 3030 | 5 | 79162381 | 80835734 |
| 3031 | 5 | 79162381 | 80971764 |
| 3032 | 5 | 79162381 | 80972258 |
| 3033 | 5 | 79162381 | 80974450 |
| 3034 | 5 | 79162381 | 81047638 |
| 3035 | 5 | 79162381 | 81082921 |
| 3036 | 5 | 79162381 | 81157909 |
| 3037 | 5 | 79162381 | 81265937 |
| 3038 | 5 | 79162381 | 81265937 |
| 3039 | 5 | 79162381 | 81267485 |
| 3040 | 5 | 79162381 | 81267499 |
| 3041 | 5 | 79162381 | 81274512 |
| 3042 | 5 | 79162381 | 81763618 |
| 3043 | 5 | 79162381 | 81797217 |
| 3044 | 5 | 79162381 | 81800186 |
| 3045 | 5 | 79162381 | 81806213 |
| 3046 | 5 | 79162381 | 81854583 |
| 3047 | 5 | 79162381 | 81859374 |
| 3048 | 5 | 79162381 | 81861368 |
| 3049 | 5 | 79162381 | 81863686 |
| 3050 | 5 | 79162381 | 81916850 |
| 3051 | 5 | 79162381 | 81954891 |
| 3052 | 5 | 79162381 | 81985250 |
| 3053 | 5 | 79162381 | 82083752 |
| 3054 | 5 | 79162381 | 82101253 |
| 3055 | 5 | 79162381 | 82143124 |
| 3056 | 5 | 79162381 | 82236318 |
| 3057 | 5 | 79162381 | 82325587 |
| 3058 | 5 | 79162381 | 82427210 |
| 3059 | 5 | 79162381 | 82431853 |
| 3060 | 5 | 79162381 | 82446714 |
| 3061 | 5 | 79162381 | 82446794 |
| 3062 | 5 | 79162381 | 82551111 |
| 3063 | 5 | 79162381 | 82552090 |
| 3064 | 5 | 79162381 | 82555641 |
| 3065 | 5 | 79162381 | 82555670 |
| 3066 | 5 | 79162381 | 82556511 |
| 3067 | 5 | 79162381 | 82559047 |
| 3068 | 5 | 79162381 | 82561535 |
| 3069 | 5 | 79162381 | 82610100 |
| 3070 | 5 | 79162381 | 82676822 |
| 3071 | 5 | 79162381 | 82676901 |
| 3072 | 5 | 79162381 | 82883691 |
| 3073 | 5 | 79162381 | 82954942 |
| 3074 | 5 | 79162381 | 82971688 |
| 3075 | 5 | 79162381 | 83023965 |
| 3076 | 5 | 79162381 | 83094205 |
| 3077 | 5 | 79162381 | 83146355 |
| 3078 | 5 | 79162381 | 83280630 |
| 3079 | 5 | 79162381 | 83281412 |
| 3080 | 5 | 79162381 | 83400242 |
| 3081 | 5 | 79162381 | 83405797 |
| 3082 | 5 | 79162381 | 83437132 |
| 3083 | 5 | 79162381 | 83522252 |
| 3084 | 5 | 79162381 | 83560095 |
| 3085 | 5 | 79162381 | 83560204 |
| 3086 | 5 | 79162381 | 83572400 |
| 3087 | 5 | 79162381 | 83607661 |
| 3088 | 5 | 79162381 | 83745342 |
| 3089 | 5 | 79162381 | 83861275 |
| 3090 | 5 | 79162381 | 83861633 |
| 3091 | 5 | 79162381 | 83865653 |
| 3092 | 5 | 79162381 | 83865914 |
| 3093 | 5 | 79162381 | 83865920 |
| 3094 | 5 | 79162381 | 83868010 |
| 3095 | 5 | 79162381 | 84019752 |
| 3096 | 5 | 79162381 | 84065912 |
| 3097 | 5 | 79162381 | 84086632 |
| 3098 | 5 | 79162381 | 84089603 |
| 3099 | 5 | 79162381 | 84104814 |
| 3100 | 5 | 79162381 | 84105175 |
| 3101 | 5 | 79162381 | 84251635 |
| 3102 | 5 | 79162381 | 84252180 |
| 3103 | 5 | 79162381 | 84253030 |
| 3104 | 5 | 79162381 | 84254208 |
| 3105 | 5 | 79162381 | 84314930 |
| 3106 | 5 | 79162381 | 84340523 |
| 3107 | 5 | 79162381 | 84516340 |
| 3108 | 5 | 79162381 | 84706916 |
| 3109 | 5 | 79162381 | 84799488 |
| 3110 | 5 | 79162381 | 84801081 |
| 3111 | 5 | 79162381 | 84824103 |
| 3112 | 5 | 79162381 | 84824203 |
| 3113 | 5 | 79162381 | 84824816 |
| 3114 | 5 | 79162381 | 84825422 |
| 3115 | 5 | 79162381 | 84825763 |
| 3116 | 5 | 79162381 | 84825942 |
| 3117 | 5 | 79162381 | 84843411 |
| 3118 | 5 | 79162381 | 84936441 |
| 3119 | 5 | 79162381 | 84936493 |
| 3120 | 5 | 79162381 | 84943705 |
| 3121 | 5 | 79162381 | 169454950 |
| 3122 | 5 | 79162381 | 181522829 |
| 3123 | 5 | 79162381 | 204759879 |
| 3124 | 5 | 79162381 | 209874191 |
| 3125 | 5 | 79175814 | 79176557 |
| 3126 | 5 | 79175814 | 79188028 |
| 3127 | 5 | 79175814 | 79201760 |
| 3128 | 5 | 79175814 | 79230005 |
| 3129 | 5 | 79175814 | 79230318 |
| 3130 | 5 | 79175814 | 79505592 |
| 3131 | 5 | 79175814 | 79510072 |
| 3132 | 5 | 79175814 | 79538012 |
| 3133 | 5 | 79175814 | 79538048 |
| 3134 | 5 | 79175814 | 79538367 |
| 3135 | 5 | 79175814 | 79669824 |
| 3136 | 5 | 79175814 | 79682242 |
| 3137 | 5 | 79175814 | 79699261 |
| 3138 | 5 | 79175814 | 79710673 |
| 3139 | 5 | 79175814 | 79861902 |
| 3140 | 5 | 79175814 | 79867710 |
| 3141 | 5 | 79175814 | 79867868 |
| 3142 | 5 | 79175814 | 79867873 |
| 3143 | 5 | 79175814 | 79961961 |
| 3144 | 5 | 79175814 | 80086268 |
| 3145 | 5 | 79175814 | 80190673 |
| 3146 | 5 | 79175814 | 80190777 |
| 3147 | 5 | 79175814 | 80192546 |
| 3148 | 5 | 79175814 | 80195395 |
| 3149 | 5 | 79175814 | 80199923 |
| 3150 | 5 | 79175814 | 80241911 |
| 3151 | 5 | 79175814 | 80282785 |
| 3152 | 5 | 79175814 | 80345337 |
| 3153 | 5 | 79175814 | 80389787 |
| 3154 | 5 | 79175814 | 80411639 |
| 3155 | 5 | 79175814 | 80446855 |
| 3156 | 5 | 79175814 | 80492790 |
| 3157 | 5 | 79175814 | 80670554 |
| 3158 | 5 | 79175814 | 80674679 |

TABLE 1-continued

Examples of chromosomal segments associated with increased fertility in maize.

| Chromosomal Segment | Chr. | Boundary 1 | Boundary 2 |
|---|---|---|---|
| 3159 | 5 | 79175814 | 80720509 |
| 3160 | 5 | 79175814 | 80800856 |
| 3161 | 5 | 79175814 | 80804587 |
| 3162 | 5 | 79175814 | 80807409 |
| 3163 | 5 | 79175814 | 80835734 |
| 3164 | 5 | 79175814 | 80971764 |
| 3165 | 5 | 79175814 | 80972258 |
| 3166 | 5 | 79175814 | 80974450 |
| 3167 | 5 | 79175814 | 81047638 |
| 3168 | 5 | 79175814 | 81082921 |
| 3169 | 5 | 79175814 | 81157909 |
| 3170 | 5 | 79175814 | 81265937 |
| 3171 | 5 | 79175814 | 81265937 |
| 3172 | 5 | 79175814 | 81267485 |
| 3173 | 5 | 79175814 | 81267499 |
| 3174 | 5 | 79175814 | 81274512 |
| 3175 | 5 | 79175814 | 81763618 |
| 3176 | 5 | 79175814 | 81797217 |
| 3177 | 5 | 79175814 | 81800186 |
| 3178 | 5 | 79175814 | 81806213 |
| 3179 | 5 | 79175814 | 81854583 |
| 3180 | 5 | 79175814 | 81859374 |
| 3181 | 5 | 79175814 | 81861368 |
| 3182 | 5 | 79175814 | 81863686 |
| 3183 | 5 | 79175814 | 81916850 |
| 3184 | 5 | 79175814 | 81954891 |
| 3185 | 5 | 79175814 | 81985250 |
| 3186 | 5 | 79175814 | 82083752 |
| 3187 | 5 | 79175814 | 82101253 |
| 3188 | 5 | 79175814 | 82143124 |
| 3189 | 5 | 79175814 | 82236318 |
| 3190 | 5 | 79175814 | 82325587 |
| 3191 | 5 | 79175814 | 82427210 |
| 3192 | 5 | 79175814 | 82431853 |
| 3193 | 5 | 79175814 | 82446714 |
| 3194 | 5 | 79175814 | 82446794 |
| 3195 | 5 | 79175814 | 82551111 |
| 3196 | 5 | 79175814 | 82552090 |
| 3197 | 5 | 79175814 | 82555641 |
| 3198 | 5 | 79175814 | 82555670 |
| 3199 | 5 | 79175814 | 82556511 |
| 3200 | 5 | 79175814 | 82559047 |
| 3201 | 5 | 79175814 | 82561535 |
| 3202 | 5 | 79175814 | 82610100 |
| 3203 | 5 | 79175814 | 82676822 |
| 3204 | 5 | 79175814 | 82676901 |
| 3205 | 5 | 79175814 | 82883691 |
| 3206 | 5 | 79175814 | 82954942 |
| 3207 | 5 | 79175814 | 82971688 |
| 3208 | 5 | 79175814 | 83023965 |
| 3209 | 5 | 79175814 | 83094205 |
| 3210 | 5 | 79175814 | 83146355 |
| 3211 | 5 | 79175814 | 83280630 |
| 3212 | 5 | 79175814 | 83281412 |
| 3213 | 5 | 79175814 | 83400242 |
| 3214 | 5 | 79175814 | 83405797 |
| 3215 | 5 | 79175814 | 83437132 |
| 3216 | 5 | 79175814 | 83522252 |
| 3217 | 5 | 79175814 | 83560095 |
| 3218 | 5 | 79175814 | 83560204 |
| 3219 | 5 | 79175814 | 83572400 |
| 3220 | 5 | 79175814 | 83607661 |
| 3221 | 5 | 79175814 | 83745342 |
| 3222 | 5 | 79175814 | 83861275 |
| 3223 | 5 | 79175814 | 83861633 |
| 3224 | 5 | 79175814 | 83865653 |
| 3225 | 5 | 79175814 | 83865914 |
| 3226 | 5 | 79175814 | 83865920 |
| 3227 | 5 | 79175814 | 83868010 |
| 3228 | 5 | 79175814 | 84019752 |
| 3229 | 5 | 79175814 | 84065912 |
| 3230 | 5 | 79175814 | 84086632 |
| 3231 | 5 | 79175814 | 84089603 |
| 3232 | 5 | 79175814 | 84104814 |
| 3233 | 5 | 79175814 | 84105175 |
| 3234 | 5 | 79175814 | 84251635 |
| 3235 | 5 | 79175814 | 84252180 |
| 3236 | 5 | 79175814 | 84253030 |
| 3237 | 5 | 79175814 | 84254208 |
| 3238 | 5 | 79175814 | 84314930 |
| 3239 | 5 | 79175814 | 84340523 |
| 3240 | 5 | 79175814 | 84516340 |
| 3241 | 5 | 79175814 | 84706916 |
| 3242 | 5 | 79175814 | 84799488 |
| 3243 | 5 | 79175814 | 84801081 |
| 3244 | 5 | 79175814 | 84824103 |
| 3245 | 5 | 79175814 | 84824203 |
| 3246 | 5 | 79175814 | 84824816 |
| 3247 | 5 | 79175814 | 84825422 |
| 3248 | 5 | 79175814 | 84825763 |
| 3249 | 5 | 79175814 | 84825942 |
| 3250 | 5 | 79175814 | 84843411 |
| 3251 | 5 | 79175814 | 84936441 |
| 3252 | 5 | 79175814 | 84936493 |
| 3253 | 5 | 79175814 | 84943705 |
| 3254 | 5 | 79175814 | 169454950 |
| 3255 | 5 | 79175814 | 181522829 |
| 3256 | 5 | 79175814 | 204759879 |
| 3257 | 5 | 79175814 | 209874191 |
| 3258 | 5 | 79183135 | 79188028 |
| 3259 | 5 | 79183135 | 79201760 |
| 3260 | 5 | 79183135 | 79230005 |
| 3261 | 5 | 79183135 | 79230318 |
| 3262 | 5 | 79183135 | 79505592 |
| 3263 | 5 | 79183135 | 79510072 |
| 3264 | 5 | 79183135 | 79538012 |
| 3265 | 5 | 79183135 | 79538048 |
| 3266 | 5 | 79183135 | 79538367 |
| 3267 | 5 | 79183135 | 79669824 |
| 3268 | 5 | 79183135 | 79682242 |
| 3269 | 5 | 79183135 | 79699261 |
| 3270 | 5 | 79183135 | 79710673 |
| 3271 | 5 | 79183135 | 79861902 |
| 3272 | 5 | 79183135 | 79867710 |
| 3273 | 5 | 79183135 | 79867868 |
| 3274 | 5 | 79183135 | 79867873 |
| 3275 | 5 | 79183135 | 79961961 |
| 3276 | 5 | 79183135 | 80086268 |
| 3277 | 5 | 79183135 | 80190673 |
| 3278 | 5 | 79183135 | 80190777 |
| 3279 | 5 | 79183135 | 80192546 |
| 3280 | 5 | 79183135 | 80195395 |
| 3281 | 5 | 79183135 | 80199923 |
| 3282 | 5 | 79183135 | 80241911 |
| 3283 | 5 | 79183135 | 80282785 |
| 3284 | 5 | 79183135 | 80345337 |
| 3285 | 5 | 79183135 | 80389787 |
| 3286 | 5 | 79183135 | 80411639 |
| 3287 | 5 | 79183135 | 80446855 |
| 3288 | 5 | 79183135 | 80492790 |
| 3289 | 5 | 79183135 | 80670554 |
| 3290 | 5 | 79183135 | 80674679 |
| 3291 | 5 | 79183135 | 80720509 |
| 3292 | 5 | 79183135 | 80800856 |
| 3293 | 5 | 79183135 | 80804587 |
| 3294 | 5 | 79183135 | 80807409 |
| 3295 | 5 | 79183135 | 80835734 |
| 3296 | 5 | 79183135 | 80971764 |
| 3297 | 5 | 79183135 | 80972258 |
| 3298 | 5 | 79183135 | 80974450 |
| 3299 | 5 | 79183135 | 81047638 |
| 3300 | 5 | 79183135 | 81082921 |
| 3301 | 5 | 79183135 | 81157909 |
| 3302 | 5 | 79183135 | 81265937 |
| 3303 | 5 | 79183135 | 81265937 |
| 3304 | 5 | 79183135 | 81267485 |
| 3305 | 5 | 79183135 | 81267499 |
| 3306 | 5 | 79183135 | 81274512 |

TABLE 1-continued

Examples of chromosomal segments associated with increased fertility in maize.

| Chromosomal Segment | Chr. | Boundary 1 | Boundary 2 |
|---|---|---|---|
| 3307 | 5 | 79183135 | 81763618 |
| 3308 | 5 | 79183135 | 81797217 |
| 3309 | 5 | 79183135 | 81800186 |
| 3310 | 5 | 79183135 | 81806213 |
| 3311 | 5 | 79183135 | 81854583 |
| 3312 | 5 | 79183135 | 81859374 |
| 3313 | 5 | 79183135 | 81861368 |
| 3314 | 5 | 79183135 | 81863686 |
| 3315 | 5 | 79183135 | 81916850 |
| 3316 | 5 | 79183135 | 81954891 |
| 3317 | 5 | 79183135 | 81985250 |
| 3318 | 5 | 79183135 | 82083752 |
| 3319 | 5 | 79183135 | 82101253 |
| 3320 | 5 | 79183135 | 82143124 |
| 3321 | 5 | 79183135 | 82236318 |
| 3322 | 5 | 79183135 | 82325587 |
| 3323 | 5 | 79183135 | 82427210 |
| 3324 | 5 | 79183135 | 82431853 |
| 3325 | 5 | 79183135 | 82446714 |
| 3326 | 5 | 79183135 | 82446794 |
| 3327 | 5 | 79183135 | 82551111 |
| 3328 | 5 | 79183135 | 82552090 |
| 3329 | 5 | 79183135 | 82555641 |
| 3330 | 5 | 79183135 | 82555670 |
| 3331 | 5 | 79183135 | 82556511 |
| 3332 | 5 | 79183135 | 82559047 |
| 3333 | 5 | 79183135 | 82561535 |
| 3334 | 5 | 79183135 | 82610100 |
| 3335 | 5 | 79183135 | 82676822 |
| 3336 | 5 | 79183135 | 82676901 |
| 3337 | 5 | 79183135 | 82883691 |
| 3338 | 5 | 79183135 | 82954942 |
| 3339 | 5 | 79183135 | 82971688 |
| 3340 | 5 | 79183135 | 83023965 |
| 3341 | 5 | 79183135 | 83094205 |
| 3342 | 5 | 79183135 | 83146355 |
| 3343 | 5 | 79183135 | 83280630 |
| 3344 | 5 | 79183135 | 83281412 |
| 3345 | 5 | 79183135 | 83400242 |
| 3346 | 5 | 79183135 | 83405797 |
| 3347 | 5 | 79183135 | 83437132 |
| 3348 | 5 | 79183135 | 83522252 |
| 3349 | 5 | 79183135 | 83560095 |
| 3350 | 5 | 79183135 | 83560204 |
| 3351 | 5 | 79183135 | 83572400 |
| 3352 | 5 | 79183135 | 83607661 |
| 3353 | 5 | 79183135 | 83745342 |
| 3354 | 5 | 79183135 | 83861275 |
| 3355 | 5 | 79183135 | 83861633 |
| 3356 | 5 | 79183135 | 83865653 |
| 3357 | 5 | 79183135 | 83865914 |
| 3358 | 5 | 79183135 | 83865920 |
| 3359 | 5 | 79183135 | 83868010 |
| 3360 | 5 | 79183135 | 84019752 |
| 3361 | 5 | 79183135 | 84065912 |
| 3362 | 5 | 79183135 | 84086632 |
| 3363 | 5 | 79183135 | 84089603 |
| 3364 | 5 | 79183135 | 84104814 |
| 3365 | 5 | 79183135 | 84105175 |
| 3366 | 5 | 79183135 | 84251635 |
| 3367 | 5 | 79183135 | 84252180 |
| 3368 | 5 | 79183135 | 84253030 |
| 3369 | 5 | 79183135 | 84254208 |
| 3370 | 5 | 79183135 | 84314930 |
| 3371 | 5 | 79183135 | 84340523 |
| 3372 | 5 | 79183135 | 84516340 |
| 3373 | 5 | 79183135 | 84706916 |
| 3374 | 5 | 79183135 | 84799488 |
| 3375 | 5 | 79183135 | 84801081 |
| 3376 | 5 | 79183135 | 84824103 |
| 3377 | 5 | 79183135 | 84824203 |
| 3378 | 5 | 79183135 | 84824816 |
| 3379 | 5 | 79183135 | 84825422 |
| 3380 | 5 | 79183135 | 84825763 |
| 3381 | 5 | 79183135 | 84825942 |
| 3382 | 5 | 79183135 | 84843411 |
| 3383 | 5 | 79183135 | 84936441 |
| 3384 | 5 | 79183135 | 84936493 |
| 3385 | 5 | 79183135 | 84943705 |
| 3386 | 5 | 79183135 | 169454950 |
| 3387 | 5 | 79183135 | 181522829 |
| 3388 | 5 | 79183135 | 204759879 |
| 3389 | 5 | 79183135 | 209874191 |
| 3390 | 5 | 79200056 | 79201760 |
| 3391 | 5 | 79200056 | 79230005 |
| 3392 | 5 | 79200056 | 79230318 |
| 3393 | 5 | 79200056 | 79505592 |
| 3394 | 5 | 79200056 | 79510072 |
| 3395 | 5 | 79200056 | 79538012 |
| 3396 | 5 | 79200056 | 79538048 |
| 3397 | 5 | 79200056 | 79538367 |
| 3398 | 5 | 79200056 | 79669824 |
| 3399 | 5 | 79200056 | 79682242 |
| 3400 | 5 | 79200056 | 79699261 |
| 3401 | 5 | 79200056 | 79710673 |
| 3402 | 5 | 79200056 | 79861902 |
| 3403 | 5 | 79200056 | 79867710 |
| 3404 | 5 | 79200056 | 79867868 |
| 3405 | 5 | 79200056 | 79867873 |
| 3406 | 5 | 79200056 | 79961961 |
| 3407 | 5 | 79200056 | 80086268 |
| 3408 | 5 | 79200056 | 80190673 |
| 3409 | 5 | 79200056 | 80190777 |
| 3410 | 5 | 79200056 | 80192546 |
| 3411 | 5 | 79200056 | 80195395 |
| 3412 | 5 | 79200056 | 80199923 |
| 3413 | 5 | 79200056 | 80241911 |
| 3414 | 5 | 79200056 | 80282785 |
| 3415 | 5 | 79200056 | 80345337 |
| 3416 | 5 | 79200056 | 80389787 |
| 3417 | 5 | 79200056 | 80411639 |
| 3418 | 5 | 79200056 | 80446855 |
| 3419 | 5 | 79200056 | 80492790 |
| 3420 | 5 | 79200056 | 80670554 |
| 3421 | 5 | 79200056 | 80674679 |
| 3422 | 5 | 79200056 | 80720509 |
| 3423 | 5 | 79200056 | 80800856 |
| 3424 | 5 | 79200056 | 80804587 |
| 3425 | 5 | 79200056 | 80807409 |
| 3426 | 5 | 79200056 | 80835734 |
| 3427 | 5 | 79200056 | 80971764 |
| 3428 | 5 | 79200056 | 80972258 |
| 3429 | 5 | 79200056 | 80974450 |
| 3430 | 5 | 79200056 | 81047638 |
| 3431 | 5 | 79200056 | 81082921 |
| 3432 | 5 | 79200056 | 81157909 |
| 3433 | 5 | 79200056 | 81265937 |
| 3434 | 5 | 79200056 | 81265937 |
| 3435 | 5 | 79200056 | 81267485 |
| 3436 | 5 | 79200056 | 81267499 |
| 3437 | 5 | 79200056 | 81274512 |
| 3438 | 5 | 79200056 | 81763618 |
| 3439 | 5 | 79200056 | 81797217 |
| 3440 | 5 | 79200056 | 81800186 |
| 3441 | 5 | 79200056 | 81806213 |
| 3442 | 5 | 79200056 | 81854583 |
| 3443 | 5 | 79200056 | 81859374 |
| 3444 | 5 | 79200056 | 81861368 |
| 3445 | 5 | 79200056 | 81863686 |
| 3446 | 5 | 79200056 | 81916850 |
| 3447 | 5 | 79200056 | 81954891 |
| 3448 | 5 | 79200056 | 81985250 |
| 3449 | 5 | 79200056 | 82083752 |
| 3450 | 5 | 79200056 | 82101253 |
| 3451 | 5 | 79200056 | 82143124 |
| 3452 | 5 | 79200056 | 82236318 |
| 3453 | 5 | 79200056 | 82325587 |
| 3454 | 5 | 79200056 | 82427210 |

TABLE 1-continued

Examples of chromosomal segments associated with increased fertility in maize.

| Chromosomal Segment | Chr. | Boundary 1 | Boundary 2 |
|---|---|---|---|
| 3455 | 5 | 79200056 | 82431853 |
| 3456 | 5 | 79200056 | 82446714 |
| 3457 | 5 | 79200056 | 82446794 |
| 3458 | 5 | 79200056 | 82551111 |
| 3459 | 5 | 79200056 | 82552090 |
| 3460 | 5 | 79200056 | 82555641 |
| 3461 | 5 | 79200056 | 82555670 |
| 3462 | 5 | 79200056 | 82556511 |
| 3463 | 5 | 79200056 | 82559047 |
| 3464 | 5 | 79200056 | 82561535 |
| 3465 | 5 | 79200056 | 82610100 |
| 3466 | 5 | 79200056 | 82676822 |
| 3467 | 5 | 79200056 | 82676901 |
| 3468 | 5 | 79200056 | 82883691 |
| 3469 | 5 | 79200056 | 82954942 |
| 3470 | 5 | 79200056 | 82971688 |
| 3471 | 5 | 79200056 | 83023965 |
| 3472 | 5 | 79200056 | 83094205 |
| 3473 | 5 | 79200056 | 83146355 |
| 3474 | 5 | 79200056 | 83280630 |
| 3475 | 5 | 79200056 | 83281412 |
| 3476 | 5 | 79200056 | 83400242 |
| 3477 | 5 | 79200056 | 83405797 |
| 3478 | 5 | 79200056 | 83437132 |
| 3479 | 5 | 79200056 | 83522252 |
| 3480 | 5 | 79200056 | 83560095 |
| 3481 | 5 | 79200056 | 83560204 |
| 3482 | 5 | 79200056 | 83572400 |
| 3483 | 5 | 79200056 | 83607661 |
| 3484 | 5 | 79200056 | 83745342 |
| 3485 | 5 | 79200056 | 83861275 |
| 3486 | 5 | 79200056 | 83861633 |
| 3487 | 5 | 79200056 | 83865653 |
| 3488 | 5 | 79200056 | 83865914 |
| 3489 | 5 | 79200056 | 83865920 |
| 3490 | 5 | 79200056 | 83868010 |
| 3491 | 5 | 79200056 | 84019752 |
| 3492 | 5 | 79200056 | 84065912 |
| 3493 | 5 | 79200056 | 84086632 |
| 3494 | 5 | 79200056 | 84089603 |
| 3495 | 5 | 79200056 | 84104814 |
| 3496 | 5 | 79200056 | 84105175 |
| 3497 | 5 | 79200056 | 84251635 |
| 3498 | 5 | 79200056 | 84252180 |
| 3499 | 5 | 79200056 | 84253030 |
| 3500 | 5 | 79200056 | 84254208 |
| 3501 | 5 | 79200056 | 84314930 |
| 3502 | 5 | 79200056 | 84340523 |
| 3503 | 5 | 79200056 | 84516340 |
| 3504 | 5 | 79200056 | 84706916 |
| 3505 | 5 | 79200056 | 84799488 |
| 3506 | 5 | 79200056 | 84801081 |
| 3507 | 5 | 79200056 | 84824103 |
| 3508 | 5 | 79200056 | 84824203 |
| 3509 | 5 | 79200056 | 84824816 |
| 3510 | 5 | 79200056 | 84825422 |
| 3511 | 5 | 79200056 | 84825763 |
| 3512 | 5 | 79200056 | 84825942 |
| 3513 | 5 | 79200056 | 84843411 |
| 3514 | 5 | 79200056 | 84936441 |
| 3515 | 5 | 79200056 | 84936493 |
| 3516 | 5 | 79200056 | 84943705 |
| 3517 | 5 | 79200056 | 169454950 |
| 3518 | 5 | 79200056 | 181522829 |
| 3519 | 5 | 79200056 | 204759879 |
| 3520 | 5 | 79200056 | 209874191 |
| 3521 | 5 | 79229010 | 79230005 |
| 3522 | 5 | 79229010 | 79230318 |
| 3523 | 5 | 79229010 | 79505592 |
| 3524 | 5 | 79229010 | 79510072 |
| 3525 | 5 | 79229010 | 79538012 |
| 3526 | 5 | 79229010 | 79538048 |
| 3527 | 5 | 79229010 | 79538367 |
| 3528 | 5 | 79229010 | 79669824 |
| 3529 | 5 | 79229010 | 79682242 |
| 3530 | 5 | 79229010 | 79699261 |
| 3531 | 5 | 79229010 | 79710673 |
| 3532 | 5 | 79229010 | 79861902 |
| 3533 | 5 | 79229010 | 79867710 |
| 3534 | 5 | 79229010 | 79867868 |
| 3535 | 5 | 79229010 | 79867873 |
| 3536 | 5 | 79229010 | 79961961 |
| 3537 | 5 | 79229010 | 80086268 |
| 3538 | 5 | 79229010 | 80190673 |
| 3539 | 5 | 79229010 | 80190777 |
| 3540 | 5 | 79229010 | 80192546 |
| 3541 | 5 | 79229010 | 80195395 |
| 3542 | 5 | 79229010 | 80199923 |
| 3543 | 5 | 79229010 | 80241911 |
| 3544 | 5 | 79229010 | 80282785 |
| 3545 | 5 | 79229010 | 80345337 |
| 3546 | 5 | 79229010 | 80389787 |
| 3547 | 5 | 79229010 | 80411639 |
| 3548 | 5 | 79229010 | 80446855 |
| 3549 | 5 | 79229010 | 80492790 |
| 3550 | 5 | 79229010 | 80670554 |
| 3551 | 5 | 79229010 | 80674679 |
| 3552 | 5 | 79229010 | 80720509 |
| 3553 | 5 | 79229010 | 80800856 |
| 3554 | 5 | 79229010 | 80804587 |
| 3555 | 5 | 79229010 | 80807409 |
| 3556 | 5 | 79229010 | 80835734 |
| 3557 | 5 | 79229010 | 80971764 |
| 3558 | 5 | 79229010 | 80972258 |
| 3559 | 5 | 79229010 | 80974450 |
| 3560 | 5 | 79229010 | 81047638 |
| 3561 | 5 | 79229010 | 81082921 |
| 3562 | 5 | 79229010 | 81157909 |
| 3563 | 5 | 79229010 | 81265937 |
| 3564 | 5 | 79229010 | 81265937 |
| 3565 | 5 | 79229010 | 81267485 |
| 3566 | 5 | 79229010 | 81267499 |
| 3567 | 5 | 79229010 | 81274512 |
| 3568 | 5 | 79229010 | 81763618 |
| 3569 | 5 | 79229010 | 81797217 |
| 3570 | 5 | 79229010 | 81800186 |
| 3571 | 5 | 79229010 | 81806213 |
| 3572 | 5 | 79229010 | 81854583 |
| 3573 | 5 | 79229010 | 81859374 |
| 3574 | 5 | 79229010 | 81861368 |
| 3575 | 5 | 79229010 | 81863686 |
| 3576 | 5 | 79229010 | 81916850 |
| 3577 | 5 | 79229010 | 81954891 |
| 3578 | 5 | 79229010 | 81985250 |
| 3579 | 5 | 79229010 | 82083752 |
| 3580 | 5 | 79229010 | 82101253 |
| 3581 | 5 | 79229010 | 82143124 |
| 3582 | 5 | 79229010 | 82236318 |
| 3583 | 5 | 79229010 | 82325587 |
| 3584 | 5 | 79229010 | 82427210 |
| 3585 | 5 | 79229010 | 82431853 |
| 3586 | 5 | 79229010 | 82446714 |
| 3587 | 5 | 79229010 | 82446794 |
| 3588 | 5 | 79229010 | 82551111 |
| 3589 | 5 | 79229010 | 82552090 |
| 3590 | 5 | 79229010 | 82555641 |
| 3591 | 5 | 79229010 | 82555670 |
| 3592 | 5 | 79229010 | 82556511 |
| 3593 | 5 | 79229010 | 82559047 |
| 3594 | 5 | 79229010 | 82561535 |
| 3595 | 5 | 79229010 | 82610100 |
| 3596 | 5 | 79229010 | 82676822 |
| 3597 | 5 | 79229010 | 82676901 |
| 3598 | 5 | 79229010 | 82883691 |
| 3599 | 5 | 79229010 | 82954942 |
| 3600 | 5 | 79229010 | 82971688 |
| 3601 | 5 | 79229010 | 83023965 |
| 3602 | 5 | 79229010 | 83094205 |

TABLE 1-continued

Examples of chromosomal segments associated with increased fertility in maize.

| Chromosomal Segment | Chr. | Boundary 1 | Boundary 2 |
|---|---|---|---|
| 3603 | 5 | 79229010 | 83146355 |
| 3604 | 5 | 79229010 | 83280630 |
| 3605 | 5 | 79229010 | 83281412 |
| 3606 | 5 | 79229010 | 83400242 |
| 3607 | 5 | 79229010 | 83405797 |
| 3608 | 5 | 79229010 | 83437132 |
| 3609 | 5 | 79229010 | 83522252 |
| 3610 | 5 | 79229010 | 83560095 |
| 3611 | 5 | 79229010 | 83560204 |
| 3612 | 5 | 79229010 | 83572400 |
| 3613 | 5 | 79229010 | 83607661 |
| 3614 | 5 | 79229010 | 83745342 |
| 3615 | 5 | 79229010 | 83861275 |
| 3616 | 5 | 79229010 | 83861633 |
| 3617 | 5 | 79229010 | 83865653 |
| 3618 | 5 | 79229010 | 83865914 |
| 3619 | 5 | 79229010 | 83865920 |
| 3620 | 5 | 79229010 | 83868010 |
| 3621 | 5 | 79229010 | 84019752 |
| 3622 | 5 | 79229010 | 84065912 |
| 3623 | 5 | 79229010 | 84086632 |
| 3624 | 5 | 79229010 | 84089603 |
| 3625 | 5 | 79229010 | 84104814 |
| 3626 | 5 | 79229010 | 84105175 |
| 3627 | 5 | 79229010 | 84251635 |
| 3628 | 5 | 79229010 | 84252180 |
| 3629 | 5 | 79229010 | 84253030 |
| 3630 | 5 | 79229010 | 84254208 |
| 3631 | 5 | 79229010 | 84314930 |
| 3632 | 5 | 79229010 | 84340523 |
| 3633 | 5 | 79229010 | 84516340 |
| 3634 | 5 | 79229010 | 84706916 |
| 3635 | 5 | 79229010 | 84799488 |
| 3636 | 5 | 79229010 | 84801081 |
| 3637 | 5 | 79229010 | 84824103 |
| 3638 | 5 | 79229010 | 84824203 |
| 3639 | 5 | 79229010 | 84824816 |
| 3640 | 5 | 79229010 | 84825422 |
| 3641 | 5 | 79229010 | 84825763 |
| 3642 | 5 | 79229010 | 84825942 |
| 3643 | 5 | 79229010 | 84843411 |
| 3644 | 5 | 79229010 | 84936441 |
| 3645 | 5 | 79229010 | 84936493 |
| 3646 | 5 | 79229010 | 84943705 |
| 3647 | 5 | 79229010 | 169454950 |
| 3648 | 5 | 79229010 | 181522829 |
| 3649 | 5 | 79229010 | 204759879 |
| 3650 | 5 | 79229010 | 209874191 |
| 3651 | 5 | 79229019 | 79230005 |
| 3652 | 5 | 79229019 | 79230318 |
| 3653 | 5 | 79229019 | 79505592 |
| 3654 | 5 | 79229019 | 79510072 |
| 3655 | 5 | 79229019 | 79538012 |
| 3656 | 5 | 79229019 | 79538048 |
| 3657 | 5 | 79229019 | 79538367 |
| 3658 | 5 | 79229019 | 79669824 |
| 3659 | 5 | 79229019 | 79682242 |
| 3660 | 5 | 79229019 | 79699261 |
| 3661 | 5 | 79229019 | 79710673 |
| 3662 | 5 | 79229019 | 79861902 |
| 3663 | 5 | 79229019 | 79867710 |
| 3664 | 5 | 79229019 | 79867868 |
| 3665 | 5 | 79229019 | 79867873 |
| 3666 | 5 | 79229019 | 79961961 |
| 3667 | 5 | 79229019 | 80086268 |
| 3668 | 5 | 79229019 | 80190673 |
| 3669 | 5 | 79229019 | 80190777 |
| 3670 | 5 | 79229019 | 80192546 |
| 3671 | 5 | 79229019 | 80195395 |
| 3672 | 5 | 79229019 | 80199923 |
| 3673 | 5 | 79229019 | 80241911 |
| 3674 | 5 | 79229019 | 80282785 |
| 3675 | 5 | 79229019 | 80345337 |
| 3676 | 5 | 79229019 | 80389787 |
| 3677 | 5 | 79229019 | 80411639 |
| 3678 | 5 | 79229019 | 80446855 |
| 3679 | 5 | 79229019 | 80492790 |
| 3680 | 5 | 79229019 | 80670554 |
| 3681 | 5 | 79229019 | 80674679 |
| 3682 | 5 | 79229019 | 80720509 |
| 3683 | 5 | 79229019 | 80800856 |
| 3684 | 5 | 79229019 | 80804587 |
| 3685 | 5 | 79229019 | 80807409 |
| 3686 | 5 | 79229019 | 80835734 |
| 3687 | 5 | 79229019 | 80971764 |
| 3688 | 5 | 79229019 | 80972258 |
| 3689 | 5 | 79229019 | 80974450 |
| 3690 | 5 | 79229019 | 81047638 |
| 3691 | 5 | 79229019 | 81082921 |
| 3692 | 5 | 79229019 | 81157909 |
| 3693 | 5 | 79229019 | 81265937 |
| 3694 | 5 | 79229019 | 81265937 |
| 3695 | 5 | 79229019 | 81267485 |
| 3696 | 5 | 79229019 | 81267499 |
| 3697 | 5 | 79229019 | 81274512 |
| 3698 | 5 | 79229019 | 81763618 |
| 3699 | 5 | 79229019 | 81797217 |
| 3700 | 5 | 79229019 | 81800186 |
| 3701 | 5 | 79229019 | 81806213 |
| 3702 | 5 | 79229019 | 81854583 |
| 3703 | 5 | 79229019 | 81859374 |
| 3704 | 5 | 79229019 | 81861368 |
| 3705 | 5 | 79229019 | 81863686 |
| 3706 | 5 | 79229019 | 81916850 |
| 3707 | 5 | 79229019 | 81954891 |
| 3708 | 5 | 79229019 | 81985250 |
| 3709 | 5 | 79229019 | 82083752 |
| 3710 | 5 | 79229019 | 82101253 |
| 3711 | 5 | 79229019 | 82143124 |
| 3712 | 5 | 79229019 | 82236318 |
| 3713 | 5 | 79229019 | 82325587 |
| 3714 | 5 | 79229019 | 82427210 |
| 3715 | 5 | 79229019 | 82431853 |
| 3716 | 5 | 79229019 | 82446714 |
| 3717 | 5 | 79229019 | 82446794 |
| 3718 | 5 | 79229019 | 82551111 |
| 3719 | 5 | 79229019 | 82552090 |
| 3720 | 5 | 79229019 | 82555641 |
| 3721 | 5 | 79229019 | 82555670 |
| 3722 | 5 | 79229019 | 82556511 |
| 3723 | 5 | 79229019 | 82559047 |
| 3724 | 5 | 79229019 | 82561535 |
| 3725 | 5 | 79229019 | 82610100 |
| 3726 | 5 | 79229019 | 82676822 |
| 3727 | 5 | 79229019 | 82676901 |
| 3728 | 5 | 79229019 | 82883691 |
| 3729 | 5 | 79229019 | 82954942 |
| 3730 | 5 | 79229019 | 82971688 |
| 3731 | 5 | 79229019 | 83023965 |
| 3732 | 5 | 79229019 | 83094205 |
| 3733 | 5 | 79229019 | 83146355 |
| 3734 | 5 | 79229019 | 83280630 |
| 3735 | 5 | 79229019 | 83281412 |
| 3736 | 5 | 79229019 | 83400242 |
| 3737 | 5 | 79229019 | 83405797 |
| 3738 | 5 | 79229019 | 83437132 |
| 3739 | 5 | 79229019 | 83522252 |
| 3740 | 5 | 79229019 | 83560095 |
| 3741 | 5 | 79229019 | 83560204 |
| 3742 | 5 | 79229019 | 83572400 |
| 3743 | 5 | 79229019 | 83607661 |
| 3744 | 5 | 79229019 | 83745342 |
| 3745 | 5 | 79229019 | 83861275 |
| 3746 | 5 | 79229019 | 83861633 |
| 3747 | 5 | 79229019 | 83865653 |
| 3748 | 5 | 79229019 | 83865914 |
| 3749 | 5 | 79229019 | 83865920 |
| 3750 | 5 | 79229019 | 83868010 |

TABLE 1-continued

Examples of chromosomal segments associated with increased fertility in maize.

| Chromosomal Segment | Chr. | Boundary 1 | Boundary 2 |
|---|---|---|---|
| 3751 | 5 | 79229019 | 84019752 |
| 3752 | 5 | 79229019 | 84065912 |
| 3753 | 5 | 79229019 | 84086632 |
| 3754 | 5 | 79229019 | 84089603 |
| 3755 | 5 | 79229019 | 84104814 |
| 3756 | 5 | 79229019 | 84105175 |
| 3757 | 5 | 79229019 | 84251635 |
| 3758 | 5 | 79229019 | 84252180 |
| 3759 | 5 | 79229019 | 84253030 |
| 3760 | 5 | 79229019 | 84254208 |
| 3761 | 5 | 79229019 | 84314930 |
| 3762 | 5 | 79229019 | 84340523 |
| 3763 | 5 | 79229019 | 84516340 |
| 3764 | 5 | 79229019 | 84706916 |
| 3765 | 5 | 79229019 | 84799488 |
| 3766 | 5 | 79229019 | 84801081 |
| 3767 | 5 | 79229019 | 84824103 |
| 3768 | 5 | 79229019 | 84824203 |
| 3769 | 5 | 79229019 | 84824816 |
| 3770 | 5 | 79229019 | 84825422 |
| 3771 | 5 | 79229019 | 84825763 |
| 3772 | 5 | 79229019 | 84825942 |
| 3773 | 5 | 79229019 | 84843411 |
| 3774 | 5 | 79229019 | 84936441 |
| 3775 | 5 | 79229019 | 84936493 |
| 3776 | 5 | 79229019 | 84943705 |
| 3777 | 5 | 79229019 | 169454950 |
| 3778 | 5 | 79229019 | 181522829 |
| 3779 | 5 | 79229019 | 204759879 |
| 3780 | 5 | 79229019 | 209874191 |
| 3781 | 5 | 79503885 | 79505592 |
| 3782 | 5 | 79503885 | 79510072 |
| 3783 | 5 | 79503885 | 79538012 |
| 3784 | 5 | 79503885 | 79538048 |
| 3785 | 5 | 79503885 | 79538367 |
| 3786 | 5 | 79503885 | 79669824 |
| 3787 | 5 | 79503885 | 79682242 |
| 3788 | 5 | 79503885 | 79699261 |
| 3789 | 5 | 79503885 | 79710673 |
| 3790 | 5 | 79503885 | 79861902 |
| 3791 | 5 | 79503885 | 79867710 |
| 3792 | 5 | 79503885 | 79867868 |
| 3793 | 5 | 79503885 | 79867873 |
| 3794 | 5 | 79503885 | 79961961 |
| 3795 | 5 | 79503885 | 80086268 |
| 3796 | 5 | 79503885 | 80190673 |
| 3797 | 5 | 79503885 | 80190777 |
| 3798 | 5 | 79503885 | 80192546 |
| 3799 | 5 | 79503885 | 80195395 |
| 3800 | 5 | 79503885 | 80199923 |
| 3801 | 5 | 79503885 | 80241911 |
| 3802 | 5 | 79503885 | 80282785 |
| 3803 | 5 | 79503885 | 80345337 |
| 3804 | 5 | 79503885 | 80389787 |
| 3805 | 5 | 79503885 | 80411639 |
| 3806 | 5 | 79503885 | 80446855 |
| 3807 | 5 | 79503885 | 80492790 |
| 3808 | 5 | 79503885 | 80670554 |
| 3809 | 5 | 79503885 | 80674679 |
| 3810 | 5 | 79503885 | 80720509 |
| 3811 | 5 | 79503885 | 80800856 |
| 3812 | 5 | 79503885 | 80804587 |
| 3813 | 5 | 79503885 | 80807409 |
| 3814 | 5 | 79503885 | 80835734 |
| 3815 | 5 | 79503885 | 80971764 |
| 3816 | 5 | 79503885 | 80972258 |
| 3817 | 5 | 79503885 | 80974450 |
| 3818 | 5 | 79503885 | 81047638 |
| 3819 | 5 | 79503885 | 81082921 |
| 3820 | 5 | 79503885 | 81157909 |
| 3821 | 5 | 79503885 | 81265937 |
| 3822 | 5 | 79503885 | 81265937 |
| 3823 | 5 | 79503885 | 81267485 |
| 3824 | 5 | 79503885 | 81267499 |
| 3825 | 5 | 79503885 | 81274512 |
| 3826 | 5 | 79503885 | 81763618 |
| 3827 | 5 | 79503885 | 81797217 |
| 3828 | 5 | 79503885 | 81800186 |
| 3829 | 5 | 79503885 | 81806213 |
| 3830 | 5 | 79503885 | 81854583 |
| 3831 | 5 | 79503885 | 81859374 |
| 3832 | 5 | 79503885 | 81861368 |
| 3833 | 5 | 79503885 | 81863686 |
| 3834 | 5 | 79503885 | 81916850 |
| 3835 | 5 | 79503885 | 81954891 |
| 3836 | 5 | 79503885 | 81985250 |
| 3837 | 5 | 79503885 | 82083752 |
| 3838 | 5 | 79503885 | 82101253 |
| 3839 | 5 | 79503885 | 82143124 |
| 3840 | 5 | 79503885 | 82236318 |
| 3841 | 5 | 79503885 | 82325587 |
| 3842 | 5 | 79503885 | 82427210 |
| 3843 | 5 | 79503885 | 82431853 |
| 3844 | 5 | 79503885 | 82446714 |
| 3845 | 5 | 79503885 | 82446794 |
| 3846 | 5 | 79503885 | 82551111 |
| 3847 | 5 | 79503885 | 82552090 |
| 3848 | 5 | 79503885 | 82555641 |
| 3849 | 5 | 79503885 | 82555670 |
| 3850 | 5 | 79503885 | 82556511 |
| 3851 | 5 | 79503885 | 82559047 |
| 3852 | 5 | 79503885 | 82561535 |
| 3853 | 5 | 79503885 | 82610100 |
| 3854 | 5 | 79503885 | 82676822 |
| 3855 | 5 | 79503885 | 82676901 |
| 3856 | 5 | 79503885 | 82883691 |
| 3857 | 5 | 79503885 | 82954942 |
| 3858 | 5 | 79503885 | 82971688 |
| 3859 | 5 | 79503885 | 83023965 |
| 3860 | 5 | 79503885 | 83094205 |
| 3861 | 5 | 79503885 | 83146355 |
| 3862 | 5 | 79503885 | 83280630 |
| 3863 | 5 | 79503885 | 83281412 |
| 3864 | 5 | 79503885 | 83400242 |
| 3865 | 5 | 79503885 | 83405797 |
| 3866 | 5 | 79503885 | 83437132 |
| 3867 | 5 | 79503885 | 83522252 |
| 3868 | 5 | 79503885 | 83560095 |
| 3869 | 5 | 79503885 | 83560204 |
| 3870 | 5 | 79503885 | 83572400 |
| 3871 | 5 | 79503885 | 83607661 |
| 3872 | 5 | 79503885 | 83745342 |
| 3873 | 5 | 79503885 | 83861275 |
| 3874 | 5 | 79503885 | 83861633 |
| 3875 | 5 | 79503885 | 83865653 |
| 3876 | 5 | 79503885 | 83865914 |
| 3877 | 5 | 79503885 | 83865920 |
| 3878 | 5 | 79503885 | 83868010 |
| 3879 | 5 | 79503885 | 84019752 |
| 3880 | 5 | 79503885 | 84065912 |
| 3881 | 5 | 79503885 | 84086632 |
| 3882 | 5 | 79503885 | 84089603 |
| 3883 | 5 | 79503885 | 84104814 |
| 3884 | 5 | 79503885 | 84105175 |
| 3885 | 5 | 79503885 | 84251635 |
| 3886 | 5 | 79503885 | 84252180 |
| 3887 | 5 | 79503885 | 84253030 |
| 3888 | 5 | 79503885 | 84254208 |
| 3889 | 5 | 79503885 | 84314930 |
| 3890 | 5 | 79503885 | 84340523 |
| 3891 | 5 | 79503885 | 84516340 |
| 3892 | 5 | 79503885 | 84706916 |
| 3893 | 5 | 79503885 | 84799488 |
| 3894 | 5 | 79503885 | 84801081 |
| 3895 | 5 | 79503885 | 84824103 |
| 3896 | 5 | 79503885 | 84824203 |
| 3897 | 5 | 79503885 | 84824816 |
| 3898 | 5 | 79503885 | 84825422 |

TABLE 1-continued

Examples of chromosomal segments associated with increased fertility in maize.

| Chromosomal Segment | Chr. | Boundary 1 | Boundary 2 |
| --- | --- | --- | --- |
| 3899 | 5 | 79503885 | 84825763 |
| 3900 | 5 | 79503885 | 84825942 |
| 3901 | 5 | 79503885 | 84843411 |
| 3902 | 5 | 79503885 | 84936441 |
| 3903 | 5 | 79503885 | 84936493 |
| 3904 | 5 | 79503885 | 84943705 |
| 3905 | 5 | 79503885 | 169454950 |
| 3906 | 5 | 79503885 | 181522829 |
| 3907 | 5 | 79503885 | 204759879 |
| 3908 | 5 | 79503885 | 209874191 |
| 3909 | 5 | 79505757 | 79505592 |
| 3910 | 5 | 79505757 | 79510072 |
| 3911 | 5 | 79505757 | 79538012 |
| 3912 | 5 | 79505757 | 79538048 |
| 3913 | 5 | 79505757 | 79538367 |
| 3914 | 5 | 79505757 | 79669824 |
| 3915 | 5 | 79505757 | 79682242 |
| 3916 | 5 | 79505757 | 79699261 |
| 3917 | 5 | 79505757 | 79710673 |
| 3918 | 5 | 79505757 | 79861902 |
| 3919 | 5 | 79505757 | 79867710 |
| 3920 | 5 | 79505757 | 79867868 |
| 3921 | 5 | 79505757 | 79867873 |
| 3922 | 5 | 79505757 | 79961961 |
| 3923 | 5 | 79505757 | 80086268 |
| 3924 | 5 | 79505757 | 80190673 |
| 3925 | 5 | 79505757 | 80190777 |
| 3926 | 5 | 79505757 | 80192546 |
| 3927 | 5 | 79505757 | 80195395 |
| 3928 | 5 | 79505757 | 80199923 |
| 3929 | 5 | 79505757 | 80241911 |
| 3930 | 5 | 79505757 | 80282785 |
| 3931 | 5 | 79505757 | 80345337 |
| 3932 | 5 | 79505757 | 80389787 |
| 3933 | 5 | 79505757 | 80411639 |
| 3934 | 5 | 79505757 | 80446855 |
| 3935 | 5 | 79505757 | 80492790 |
| 3936 | 5 | 79505757 | 80670554 |
| 3937 | 5 | 79505757 | 80674679 |
| 3938 | 5 | 79505757 | 80720509 |
| 3939 | 5 | 79505757 | 80800856 |
| 3940 | 5 | 79505757 | 80804587 |
| 3941 | 5 | 79505757 | 80807409 |
| 3942 | 5 | 79505757 | 80835734 |
| 3943 | 5 | 79505757 | 80971764 |
| 3944 | 5 | 79505757 | 80972258 |
| 3945 | 5 | 79505757 | 80974450 |
| 3946 | 5 | 79505757 | 81047638 |
| 3947 | 5 | 79505757 | 81082921 |
| 3948 | 5 | 79505757 | 81157909 |
| 3949 | 5 | 79505757 | 81265937 |
| 3950 | 5 | 79505757 | 81265937 |
| 3951 | 5 | 79505757 | 81267485 |
| 3952 | 5 | 79505757 | 81267499 |
| 3953 | 5 | 79505757 | 81274512 |
| 3954 | 5 | 79505757 | 81763618 |
| 3955 | 5 | 79505757 | 81797217 |
| 3956 | 5 | 79505757 | 81800186 |
| 3957 | 5 | 79505757 | 81806213 |
| 3958 | 5 | 79505757 | 81854583 |
| 3959 | 5 | 79505757 | 81859374 |
| 3960 | 5 | 79505757 | 81861368 |
| 3961 | 5 | 79505757 | 81863686 |
| 3962 | 5 | 79505757 | 81916850 |
| 3963 | 5 | 79505757 | 81954891 |
| 3964 | 5 | 79505757 | 81985250 |
| 3965 | 5 | 79505757 | 82083752 |
| 3966 | 5 | 79505757 | 82101253 |
| 3967 | 5 | 79505757 | 82143124 |
| 3968 | 5 | 79505757 | 82236318 |
| 3969 | 5 | 79505757 | 82325587 |
| 3970 | 5 | 79505757 | 82427210 |
| 3971 | 5 | 79505757 | 82431853 |
| 3972 | 5 | 79505757 | 82446714 |
| 3973 | 5 | 79505757 | 82446794 |
| 3974 | 5 | 79505757 | 82551111 |
| 3975 | 5 | 79505757 | 82552090 |
| 3976 | 5 | 79505757 | 82555641 |
| 3977 | 5 | 79505757 | 82555670 |
| 3978 | 5 | 79505757 | 82556511 |
| 3979 | 5 | 79505757 | 82559047 |
| 3980 | 5 | 79505757 | 82561535 |
| 3981 | 5 | 79505757 | 82610100 |
| 3982 | 5 | 79505757 | 82676822 |
| 3983 | 5 | 79505757 | 82676901 |
| 3984 | 5 | 79505757 | 82883691 |
| 3985 | 5 | 79505757 | 82954942 |
| 3986 | 5 | 79505757 | 82971688 |
| 3987 | 5 | 79505757 | 83023965 |
| 3988 | 5 | 79505757 | 83094205 |
| 3989 | 5 | 79505757 | 83146355 |
| 3990 | 5 | 79505757 | 83280630 |
| 3991 | 5 | 79505757 | 83281412 |
| 3992 | 5 | 79505757 | 83400242 |
| 3993 | 5 | 79505757 | 83405797 |
| 3994 | 5 | 79505757 | 83437132 |
| 3995 | 5 | 79505757 | 83522252 |
| 3996 | 5 | 79505757 | 83560095 |
| 3997 | 5 | 79505757 | 83560204 |
| 3998 | 5 | 79505757 | 83572400 |
| 3999 | 5 | 79505757 | 83607661 |
| 4000 | 5 | 79505757 | 83745342 |
| 4001 | 5 | 79505757 | 83861275 |
| 4002 | 5 | 79505757 | 83861633 |
| 4003 | 5 | 79505757 | 83865653 |
| 4004 | 5 | 79505757 | 83865914 |
| 4005 | 5 | 79505757 | 83865920 |
| 4006 | 5 | 79505757 | 83868010 |
| 4007 | 5 | 79505757 | 84019752 |
| 4008 | 5 | 79505757 | 84065912 |
| 4009 | 5 | 79505757 | 84086632 |
| 4010 | 5 | 79505757 | 84089603 |
| 4011 | 5 | 79505757 | 84104814 |
| 4012 | 5 | 79505757 | 84105175 |
| 4013 | 5 | 79505757 | 84251635 |
| 4014 | 5 | 79505757 | 84252180 |
| 4015 | 5 | 79505757 | 84253030 |
| 4016 | 5 | 79505757 | 84254208 |
| 4017 | 5 | 79505757 | 84314930 |
| 4018 | 5 | 79505757 | 84340523 |
| 4019 | 5 | 79505757 | 84516340 |
| 4020 | 5 | 79505757 | 84706916 |
| 4021 | 5 | 79505757 | 84799488 |
| 4022 | 5 | 79505757 | 84801081 |
| 4023 | 5 | 79505757 | 84824103 |
| 4024 | 5 | 79505757 | 84824203 |
| 4025 | 5 | 79505757 | 84824816 |
| 4026 | 5 | 79505757 | 84825422 |
| 4027 | 5 | 79505757 | 84825763 |
| 4028 | 5 | 79505757 | 84825942 |
| 4029 | 5 | 79505757 | 84843411 |
| 4030 | 5 | 79505757 | 84936441 |
| 4031 | 5 | 79505757 | 84936493 |
| 4032 | 5 | 79505757 | 84943705 |
| 4033 | 5 | 79505757 | 169454950 |
| 4034 | 5 | 79505757 | 181522829 |
| 4035 | 5 | 79505757 | 204759879 |
| 4036 | 5 | 79505757 | 209874191 |
| 4037 | 5 | 79531009 | 79538012 |
| 4038 | 5 | 79531009 | 79538048 |
| 4039 | 5 | 79531009 | 79538367 |
| 4040 | 5 | 79531009 | 79669824 |
| 4041 | 5 | 79531009 | 79682242 |
| 4042 | 5 | 79531009 | 79699261 |
| 4043 | 5 | 79531009 | 79710673 |
| 4044 | 5 | 79531009 | 79861902 |
| 4045 | 5 | 79531009 | 79867710 |
| 4046 | 5 | 79531009 | 79867868 |

TABLE 1-continued

Examples of chromosomal segments associated with increased fertility in maize.

| Chromosomal Segment | Chr. | Boundary 1 | Boundary 2 |
|---|---|---|---|
| 4047 | 5 | 79531009 | 79867873 |
| 4048 | 5 | 79531009 | 79961961 |
| 4049 | 5 | 79531009 | 80086268 |
| 4050 | 5 | 79531009 | 80190673 |
| 4051 | 5 | 79531009 | 80190777 |
| 4052 | 5 | 79531009 | 80192546 |
| 4053 | 5 | 79531009 | 80195395 |
| 4054 | 5 | 79531009 | 80199923 |
| 4055 | 5 | 79531009 | 80241911 |
| 4056 | 5 | 79531009 | 80282785 |
| 4057 | 5 | 79531009 | 80345337 |
| 4058 | 5 | 79531009 | 80389787 |
| 4059 | 5 | 79531009 | 80411639 |
| 4060 | 5 | 79531009 | 80446855 |
| 4061 | 5 | 79531009 | 80492790 |
| 4062 | 5 | 79531009 | 80670554 |
| 4063 | 5 | 79531009 | 80674679 |
| 4064 | 5 | 79531009 | 80720509 |
| 4065 | 5 | 79531009 | 80800856 |
| 4066 | 5 | 79531009 | 80804587 |
| 4067 | 5 | 79531009 | 80807409 |
| 4068 | 5 | 79531009 | 80835734 |
| 4069 | 5 | 79531009 | 80971764 |
| 4070 | 5 | 79531009 | 80972258 |
| 4071 | 5 | 79531009 | 80974450 |
| 4072 | 5 | 79531009 | 81047638 |
| 4073 | 5 | 79531009 | 81082921 |
| 4074 | 5 | 79531009 | 81157909 |
| 4075 | 5 | 79531009 | 81265937 |
| 4076 | 5 | 79531009 | 81265937 |
| 4077 | 5 | 79531009 | 81267485 |
| 4078 | 5 | 79531009 | 81267499 |
| 4079 | 5 | 79531009 | 81274512 |
| 4080 | 5 | 79531009 | 81763618 |
| 4081 | 5 | 79531009 | 81797217 |
| 4082 | 5 | 79531009 | 81800186 |
| 4083 | 5 | 79531009 | 81806213 |
| 4084 | 5 | 79531009 | 81854583 |
| 4085 | 5 | 79531009 | 81859374 |
| 4086 | 5 | 79531009 | 81861368 |
| 4087 | 5 | 79531009 | 81863686 |
| 4088 | 5 | 79531009 | 81916850 |
| 4089 | 5 | 79531009 | 81954891 |
| 4090 | 5 | 79531009 | 81985250 |
| 4091 | 5 | 79531009 | 82083752 |
| 4092 | 5 | 79531009 | 82101253 |
| 4093 | 5 | 79531009 | 82143124 |
| 4094 | 5 | 79531009 | 82236318 |
| 4095 | 5 | 79531009 | 82325587 |
| 4096 | 5 | 79531009 | 82427210 |
| 4097 | 5 | 79531009 | 82431853 |
| 4098 | 5 | 79531009 | 82446714 |
| 4099 | 5 | 79531009 | 82446794 |
| 4100 | 5 | 79531009 | 82551111 |
| 4101 | 5 | 79531009 | 82552090 |
| 4102 | 5 | 79531009 | 82555641 |
| 4103 | 5 | 79531009 | 82555670 |
| 4104 | 5 | 79531009 | 82556511 |
| 4105 | 5 | 79531009 | 82559047 |
| 4106 | 5 | 79531009 | 82561535 |
| 4107 | 5 | 79531009 | 82610100 |
| 4108 | 5 | 79531009 | 82676822 |
| 4109 | 5 | 79531009 | 82676901 |
| 4110 | 5 | 79531009 | 82883691 |
| 4111 | 5 | 79531009 | 82954942 |
| 4112 | 5 | 79531009 | 82971688 |
| 4113 | 5 | 79531009 | 83023965 |
| 4114 | 5 | 79531009 | 83094205 |
| 4115 | 5 | 79531009 | 83146355 |
| 4116 | 5 | 79531009 | 83280630 |
| 4117 | 5 | 79531009 | 83281412 |
| 4118 | 5 | 79531009 | 83400242 |
| 4119 | 5 | 79531009 | 83405797 |
| 4120 | 5 | 79531009 | 83437132 |
| 4121 | 5 | 79531009 | 83522252 |
| 4122 | 5 | 79531009 | 83560095 |
| 4123 | 5 | 79531009 | 83560204 |
| 4124 | 5 | 79531009 | 83572400 |
| 4125 | 5 | 79531009 | 83607661 |
| 4126 | 5 | 79531009 | 83745342 |
| 4127 | 5 | 79531009 | 83861275 |
| 4128 | 5 | 79531009 | 83861633 |
| 4129 | 5 | 79531009 | 83865653 |
| 4130 | 5 | 79531009 | 83865914 |
| 4131 | 5 | 79531009 | 83865920 |
| 4132 | 5 | 79531009 | 83868010 |
| 4133 | 5 | 79531009 | 84019752 |
| 4134 | 5 | 79531009 | 84065912 |
| 4135 | 5 | 79531009 | 84086632 |
| 4136 | 5 | 79531009 | 84089603 |
| 4137 | 5 | 79531009 | 84104814 |
| 4138 | 5 | 79531009 | 84105175 |
| 4139 | 5 | 79531009 | 84251635 |
| 4140 | 5 | 79531009 | 84252180 |
| 4141 | 5 | 79531009 | 84253030 |
| 4142 | 5 | 79531009 | 84254208 |
| 4143 | 5 | 79531009 | 84314930 |
| 4144 | 5 | 79531009 | 84340523 |
| 4145 | 5 | 79531009 | 84516340 |
| 4146 | 5 | 79531009 | 84706916 |
| 4147 | 5 | 79531009 | 84799488 |
| 4148 | 5 | 79531009 | 84801081 |
| 4149 | 5 | 79531009 | 84824103 |
| 4150 | 5 | 79531009 | 84824203 |
| 4151 | 5 | 79531009 | 84824816 |
| 4152 | 5 | 79531009 | 84825422 |
| 4153 | 5 | 79531009 | 84825763 |
| 4154 | 5 | 79531009 | 84825942 |
| 4155 | 5 | 79531009 | 84843411 |
| 4156 | 5 | 79531009 | 84936441 |
| 4157 | 5 | 79531009 | 84936493 |
| 4158 | 5 | 79531009 | 84943705 |
| 4159 | 5 | 79531009 | 169454950 |
| 4160 | 5 | 79531009 | 181522829 |
| 4161 | 5 | 79531009 | 204759879 |
| 4162 | 5 | 79531009 | 209874191 |
| 4163 | 5 | 79531040 | 79538012 |
| 4164 | 5 | 79531040 | 79538048 |
| 4165 | 5 | 79531040 | 79538367 |
| 4166 | 5 | 79531040 | 79669824 |
| 4167 | 5 | 79531040 | 79682242 |
| 4168 | 5 | 79531040 | 79699261 |
| 4169 | 5 | 79531040 | 79710673 |
| 4170 | 5 | 79531040 | 79861902 |
| 4171 | 5 | 79531040 | 79867710 |
| 4172 | 5 | 79531040 | 79867868 |
| 4173 | 5 | 79531040 | 79867873 |
| 4174 | 5 | 79531040 | 79961961 |
| 4175 | 5 | 79531040 | 80086268 |
| 4176 | 5 | 79531040 | 80190673 |
| 4177 | 5 | 79531040 | 80190777 |
| 4178 | 5 | 79531040 | 80192546 |
| 4179 | 5 | 79531040 | 80195395 |
| 4180 | 5 | 79531040 | 80199923 |
| 4181 | 5 | 79531040 | 80241911 |
| 4182 | 5 | 79531040 | 80282785 |
| 4183 | 5 | 79531040 | 80345337 |
| 4184 | 5 | 79531040 | 80389787 |
| 4185 | 5 | 79531040 | 80411639 |
| 4186 | 5 | 79531040 | 80446855 |
| 4187 | 5 | 79531040 | 80492790 |
| 4188 | 5 | 79531040 | 80670554 |
| 4189 | 5 | 79531040 | 80674679 |
| 4190 | 5 | 79531040 | 80720509 |
| 4191 | 5 | 79531040 | 80800856 |
| 4192 | 5 | 79531040 | 80804587 |
| 4193 | 5 | 79531040 | 80807409 |
| 4194 | 5 | 79531040 | 80835734 |

TABLE 1-continued

Examples of chromosomal segments associated with increased fertility in maize.

| Chromosomal Segment | Chr. | Boundary 1 | Boundary 2 |
|---|---|---|---|
| 4195 | 5 | 79531040 | 80971764 |
| 4196 | 5 | 79531040 | 80972258 |
| 4197 | 5 | 79531040 | 80974450 |
| 4198 | 5 | 79531040 | 81047638 |
| 4199 | 5 | 79531040 | 81082921 |
| 4200 | 5 | 79531040 | 81157909 |
| 4201 | 5 | 79531040 | 81265937 |
| 4202 | 5 | 79531040 | 81265937 |
| 4203 | 5 | 79531040 | 81267485 |
| 4204 | 5 | 79531040 | 81267499 |
| 4205 | 5 | 79531040 | 81274512 |
| 4206 | 5 | 79531040 | 81763618 |
| 4207 | 5 | 79531040 | 81797217 |
| 4208 | 5 | 79531040 | 81800186 |
| 4209 | 5 | 79531040 | 81806213 |
| 4210 | 5 | 79531040 | 81854583 |
| 4211 | 5 | 79531040 | 81859374 |
| 4212 | 5 | 79531040 | 81861368 |
| 4213 | 5 | 79531040 | 81863686 |
| 4214 | 5 | 79531040 | 81916850 |
| 4215 | 5 | 79531040 | 81954891 |
| 4216 | 5 | 79531040 | 81985250 |
| 4217 | 5 | 79531040 | 82083752 |
| 4218 | 5 | 79531040 | 82101253 |
| 4219 | 5 | 79531040 | 82143124 |
| 4220 | 5 | 79531040 | 82236318 |
| 4221 | 5 | 79531040 | 82325587 |
| 4222 | 5 | 79531040 | 82427210 |
| 4223 | 5 | 79531040 | 82431853 |
| 4224 | 5 | 79531040 | 82446714 |
| 4225 | 5 | 79531040 | 82446794 |
| 4226 | 5 | 79531040 | 82551111 |
| 4227 | 5 | 79531040 | 82552090 |
| 4228 | 5 | 79531040 | 82555641 |
| 4229 | 5 | 79531040 | 82555670 |
| 4230 | 5 | 79531040 | 82556511 |
| 4231 | 5 | 79531040 | 82559047 |
| 4232 | 5 | 79531040 | 82561535 |
| 4233 | 5 | 79531040 | 82610100 |
| 4234 | 5 | 79531040 | 82676822 |
| 4235 | 5 | 79531040 | 82676901 |
| 4236 | 5 | 79531040 | 82883691 |
| 4237 | 5 | 79531040 | 82954942 |
| 4238 | 5 | 79531040 | 82971688 |
| 4239 | 5 | 79531040 | 83023965 |
| 4240 | 5 | 79531040 | 83094205 |
| 4241 | 5 | 79531040 | 83146355 |
| 4242 | 5 | 79531040 | 83280630 |
| 4243 | 5 | 79531040 | 83281412 |
| 4244 | 5 | 79531040 | 83400242 |
| 4245 | 5 | 79531040 | 83405797 |
| 4246 | 5 | 79531040 | 83437132 |
| 4247 | 5 | 79531040 | 83522252 |
| 4248 | 5 | 79531040 | 83560095 |
| 4249 | 5 | 79531040 | 83560204 |
| 4250 | 5 | 79531040 | 83572400 |
| 4251 | 5 | 79531040 | 83607661 |
| 4252 | 5 | 79531040 | 83745342 |
| 4253 | 5 | 79531040 | 83861275 |
| 4254 | 5 | 79531040 | 83861633 |
| 4255 | 5 | 79531040 | 83865653 |
| 4256 | 5 | 79531040 | 83865914 |
| 4257 | 5 | 79531040 | 83865920 |
| 4258 | 5 | 79531040 | 83868010 |
| 4259 | 5 | 79531040 | 84019752 |
| 4260 | 5 | 79531040 | 84065912 |
| 4261 | 5 | 79531040 | 84086632 |
| 4262 | 5 | 79531040 | 84089603 |
| 4263 | 5 | 79531040 | 84104814 |
| 4264 | 5 | 79531040 | 84105175 |
| 4265 | 5 | 79531040 | 84251635 |
| 4266 | 5 | 79531040 | 84252180 |
| 4267 | 5 | 79531040 | 84253030 |
| 4268 | 5 | 79531040 | 84254208 |
| 4269 | 5 | 79531040 | 84314930 |
| 4270 | 5 | 79531040 | 84340523 |
| 4271 | 5 | 79531040 | 84516340 |
| 4272 | 5 | 79531040 | 84706916 |
| 4273 | 5 | 79531040 | 84799488 |
| 4274 | 5 | 79531040 | 84801081 |
| 4275 | 5 | 79531040 | 84824103 |
| 4276 | 5 | 79531040 | 84824203 |
| 4277 | 5 | 79531040 | 84824816 |
| 4278 | 5 | 79531040 | 84825422 |
| 4279 | 5 | 79531040 | 84825763 |
| 4280 | 5 | 79531040 | 84825942 |
| 4281 | 5 | 79531040 | 84843411 |
| 4282 | 5 | 79531040 | 84936441 |
| 4283 | 5 | 79531040 | 84936493 |
| 4284 | 5 | 79531040 | 84943705 |
| 4285 | 5 | 79531040 | 169454950 |
| 4286 | 5 | 79531040 | 181522829 |
| 4287 | 5 | 79531040 | 204759879 |
| 4288 | 5 | 79531040 | 209874191 |
| 4289 | 5 | 79537564 | 79538012 |
| 4290 | 5 | 79537564 | 79538048 |
| 4291 | 5 | 79537564 | 79538367 |
| 4292 | 5 | 79537564 | 79669824 |
| 4293 | 5 | 79537564 | 79682242 |
| 4294 | 5 | 79537564 | 79699261 |
| 4295 | 5 | 79537564 | 79710673 |
| 4296 | 5 | 79537564 | 79861902 |
| 4297 | 5 | 79537564 | 79867710 |
| 4298 | 5 | 79537564 | 79867868 |
| 4299 | 5 | 79537564 | 79867873 |
| 4300 | 5 | 79537564 | 79961961 |
| 4301 | 5 | 79537564 | 80086268 |
| 4302 | 5 | 79537564 | 80190673 |
| 4303 | 5 | 79537564 | 80190777 |
| 4304 | 5 | 79537564 | 80192546 |
| 4305 | 5 | 79537564 | 80195395 |
| 4306 | 5 | 79537564 | 80199923 |
| 4307 | 5 | 79537564 | 80241911 |
| 4308 | 5 | 79537564 | 80282785 |
| 4309 | 5 | 79537564 | 80345337 |
| 4310 | 5 | 79537564 | 80389787 |
| 4311 | 5 | 79537564 | 80411639 |
| 4312 | 5 | 79537564 | 80446855 |
| 4313 | 5 | 79537564 | 80492790 |
| 4314 | 5 | 79537564 | 80670554 |
| 4315 | 5 | 79537564 | 80674679 |
| 4316 | 5 | 79537564 | 80720509 |
| 4317 | 5 | 79537564 | 80800856 |
| 4318 | 5 | 79537564 | 80804587 |
| 4319 | 5 | 79537564 | 80807409 |
| 4320 | 5 | 79537564 | 80835734 |
| 4321 | 5 | 79537564 | 80971764 |
| 4322 | 5 | 79537564 | 80972258 |
| 4323 | 5 | 79537564 | 80974450 |
| 4324 | 5 | 79537564 | 81047638 |
| 4325 | 5 | 79537564 | 81082921 |
| 4326 | 5 | 79537564 | 81157909 |
| 4327 | 5 | 79537564 | 81265937 |
| 4328 | 5 | 79537564 | 81265937 |
| 4329 | 5 | 79537564 | 81267485 |
| 4330 | 5 | 79537564 | 81267499 |
| 4331 | 5 | 79537564 | 81274512 |
| 4332 | 5 | 79537564 | 81763618 |
| 4333 | 5 | 79537564 | 81797217 |
| 4334 | 5 | 79537564 | 81800186 |
| 4335 | 5 | 79537564 | 81806213 |
| 4336 | 5 | 79537564 | 81854583 |
| 4337 | 5 | 79537564 | 81859374 |
| 4338 | 5 | 79537564 | 81861368 |
| 4339 | 5 | 79537564 | 81863686 |
| 4340 | 5 | 79537564 | 81916850 |
| 4341 | 5 | 79537564 | 81954891 |
| 4342 | 5 | 79537564 | 81985250 |

TABLE 1-continued

Examples of chromosomal segments associated with increased fertility in maize.

| Chromosomal Segment | Chr. | Boundary 1 | Boundary 2 |
| --- | --- | --- | --- |
| 4343 | 5 | 79537564 | 82083752 |
| 4344 | 5 | 79537564 | 82101253 |
| 4345 | 5 | 79537564 | 82143124 |
| 4346 | 5 | 79537564 | 82236318 |
| 4347 | 5 | 79537564 | 82325587 |
| 4348 | 5 | 79537564 | 82427210 |
| 4349 | 5 | 79537564 | 82431853 |
| 4350 | 5 | 79537564 | 82446714 |
| 4351 | 5 | 79537564 | 82446794 |
| 4352 | 5 | 79537564 | 82551111 |
| 4353 | 5 | 79537564 | 82552090 |
| 4354 | 5 | 79537564 | 82555641 |
| 4355 | 5 | 79537564 | 82555670 |
| 4356 | 5 | 79537564 | 82556511 |
| 4357 | 5 | 79537564 | 82559047 |
| 4358 | 5 | 79537564 | 82561535 |
| 4359 | 5 | 79537564 | 82610100 |
| 4360 | 5 | 79537564 | 82676822 |
| 4361 | 5 | 79537564 | 82676901 |
| 4362 | 5 | 79537564 | 82883691 |
| 4363 | 5 | 79537564 | 82954942 |
| 4364 | 5 | 79537564 | 82971688 |
| 4365 | 5 | 79537564 | 83023965 |
| 4366 | 5 | 79537564 | 83094205 |
| 4367 | 5 | 79537564 | 83146355 |
| 4368 | 5 | 79537564 | 83280630 |
| 4369 | 5 | 79537564 | 83281412 |
| 4370 | 5 | 79537564 | 83400242 |
| 4371 | 5 | 79537564 | 83405797 |
| 4372 | 5 | 79537564 | 83437132 |
| 4373 | 5 | 79537564 | 83522252 |
| 4374 | 5 | 79537564 | 83560095 |
| 4375 | 5 | 79537564 | 83560204 |
| 4376 | 5 | 79537564 | 83572400 |
| 4377 | 5 | 79537564 | 83607661 |
| 4378 | 5 | 79537564 | 83745342 |
| 4379 | 5 | 79537564 | 83861275 |
| 4380 | 5 | 79537564 | 83861633 |
| 4381 | 5 | 79537564 | 83865653 |
| 4382 | 5 | 79537564 | 83865914 |
| 4383 | 5 | 79537564 | 83865920 |
| 4384 | 5 | 79537564 | 83868010 |
| 4385 | 5 | 79537564 | 84019752 |
| 4386 | 5 | 79537564 | 84065912 |
| 4387 | 5 | 79537564 | 84086632 |
| 4388 | 5 | 79537564 | 84089603 |
| 4389 | 5 | 79537564 | 84104814 |
| 4390 | 5 | 79537564 | 84105175 |
| 4391 | 5 | 79537564 | 84251635 |
| 4392 | 5 | 79537564 | 84252180 |
| 4393 | 5 | 79537564 | 84253030 |
| 4394 | 5 | 79537564 | 84254208 |
| 4395 | 5 | 79537564 | 84314930 |
| 4396 | 5 | 79537564 | 84340523 |
| 4397 | 5 | 79537564 | 84516340 |
| 4398 | 5 | 79537564 | 84706916 |
| 4399 | 5 | 79537564 | 84799488 |
| 4400 | 5 | 79537564 | 84801081 |
| 4401 | 5 | 79537564 | 84824103 |
| 4402 | 5 | 79537564 | 84824203 |
| 4403 | 5 | 79537564 | 84824816 |
| 4404 | 5 | 79537564 | 84825422 |
| 4405 | 5 | 79537564 | 84825763 |
| 4406 | 5 | 79537564 | 84825942 |
| 4407 | 5 | 79537564 | 84843411 |
| 4408 | 5 | 79537564 | 84936441 |
| 4409 | 5 | 79537564 | 84936493 |
| 4410 | 5 | 79537564 | 84943705 |
| 4411 | 5 | 79537564 | 169454950 |
| 4412 | 5 | 79537564 | 181522829 |
| 4413 | 5 | 79537564 | 204759879 |
| 4414 | 5 | 79537564 | 209874191 |
| 4415 | 5 | 79538367 | 79669824 |
| 4416 | 5 | 79538367 | 79682242 |
| 4417 | 5 | 79538367 | 79699261 |
| 4418 | 5 | 79538367 | 79710673 |
| 4419 | 5 | 79538367 | 79861902 |
| 4420 | 5 | 79538367 | 79867710 |
| 4421 | 5 | 79538367 | 79867868 |
| 4422 | 5 | 79538367 | 79867873 |
| 4423 | 5 | 79538367 | 79961961 |
| 4424 | 5 | 79538367 | 80086268 |
| 4425 | 5 | 79538367 | 80190673 |
| 4426 | 5 | 79538367 | 80190777 |
| 4427 | 5 | 79538367 | 80192546 |
| 4428 | 5 | 79538367 | 80195395 |
| 4429 | 5 | 79538367 | 80199923 |
| 4430 | 5 | 79538367 | 80241911 |
| 4431 | 5 | 79538367 | 80282785 |
| 4432 | 5 | 79538367 | 80345337 |
| 4433 | 5 | 79538367 | 80389787 |
| 4434 | 5 | 79538367 | 80411639 |
| 4435 | 5 | 79538367 | 80446855 |
| 4436 | 5 | 79538367 | 80492790 |
| 4437 | 5 | 79538367 | 80670554 |
| 4438 | 5 | 79538367 | 80674679 |
| 4439 | 5 | 79538367 | 80720509 |
| 4440 | 5 | 79538367 | 80800856 |
| 4441 | 5 | 79538367 | 80804587 |
| 4442 | 5 | 79538367 | 80807409 |
| 4443 | 5 | 79538367 | 80835734 |
| 4444 | 5 | 79538367 | 80971764 |
| 4445 | 5 | 79538367 | 80972258 |
| 4446 | 5 | 79538367 | 80974450 |
| 4447 | 5 | 79538367 | 81047638 |
| 4448 | 5 | 79538367 | 81082921 |
| 4449 | 5 | 79538367 | 81157909 |
| 4450 | 5 | 79538367 | 81265937 |
| 4451 | 5 | 79538367 | 81265937 |
| 4452 | 5 | 79538367 | 81267485 |
| 4453 | 5 | 79538367 | 81267499 |
| 4454 | 5 | 79538367 | 81274512 |
| 4455 | 5 | 79538367 | 81763618 |
| 4456 | 5 | 79538367 | 81797217 |
| 4457 | 5 | 79538367 | 81800186 |
| 4458 | 5 | 79538367 | 81806213 |
| 4459 | 5 | 79538367 | 81854583 |
| 4460 | 5 | 79538367 | 81859374 |
| 4461 | 5 | 79538367 | 81861368 |
| 4462 | 5 | 79538367 | 81863686 |
| 4463 | 5 | 79538367 | 81916850 |
| 4464 | 5 | 79538367 | 81954891 |
| 4465 | 5 | 79538367 | 81985250 |
| 4466 | 5 | 79538367 | 82083752 |
| 4467 | 5 | 79538367 | 82101253 |
| 4468 | 5 | 79538367 | 82143124 |
| 4469 | 5 | 79538367 | 82236318 |
| 4470 | 5 | 79538367 | 82325587 |
| 4471 | 5 | 79538367 | 82427210 |
| 4472 | 5 | 79538367 | 82431853 |
| 4473 | 5 | 79538367 | 82446714 |
| 4474 | 5 | 79538367 | 82446794 |
| 4475 | 5 | 79538367 | 82551111 |
| 4476 | 5 | 79538367 | 82552090 |
| 4477 | 5 | 79538367 | 82555641 |
| 4478 | 5 | 79538367 | 82555670 |
| 4479 | 5 | 79538367 | 82556511 |
| 4480 | 5 | 79538367 | 82559047 |
| 4481 | 5 | 79538367 | 82561535 |
| 4482 | 5 | 79538367 | 82610100 |
| 4483 | 5 | 79538367 | 82676822 |
| 4484 | 5 | 79538367 | 82676901 |
| 4485 | 5 | 79538367 | 82883691 |
| 4486 | 5 | 79538367 | 82954942 |
| 4487 | 5 | 79538367 | 82971688 |
| 4488 | 5 | 79538367 | 83023965 |
| 4489 | 5 | 79538367 | 83094205 |
| 4490 | 5 | 79538367 | 83146355 |

TABLE 1-continued

Examples of chromosomal segments associated with increased fertility in maize.

| Chromosomal Segment | Chr. | Boundary 1 | Boundary 2 |
|---|---|---|---|
| 4491 | 5 | 79538367 | 83280630 |
| 4492 | 5 | 79538367 | 83281412 |
| 4493 | 5 | 79538367 | 83400242 |
| 4494 | 5 | 79538367 | 83405797 |
| 4495 | 5 | 79538367 | 83437132 |
| 4496 | 5 | 79538367 | 83522252 |
| 4497 | 5 | 79538367 | 83560095 |
| 4498 | 5 | 79538367 | 83560204 |
| 4499 | 5 | 79538367 | 83572400 |
| 4500 | 5 | 79538367 | 83607661 |
| 4501 | 5 | 79538367 | 83745342 |
| 4502 | 5 | 79538367 | 83861275 |
| 4503 | 5 | 79538367 | 83861633 |
| 4504 | 5 | 79538367 | 83865653 |
| 4505 | 5 | 79538367 | 83865914 |
| 4506 | 5 | 79538367 | 83865920 |
| 4507 | 5 | 79538367 | 83868010 |
| 4508 | 5 | 79538367 | 84019752 |
| 4509 | 5 | 79538367 | 84065912 |
| 4510 | 5 | 79538367 | 84086632 |
| 4511 | 5 | 79538367 | 84089603 |
| 4512 | 5 | 79538367 | 84104814 |
| 4513 | 5 | 79538367 | 84105175 |
| 4514 | 5 | 79538367 | 84251635 |
| 4515 | 5 | 79538367 | 84252180 |
| 4516 | 5 | 79538367 | 84253030 |
| 4517 | 5 | 79538367 | 84254208 |
| 4518 | 5 | 79538367 | 84314930 |
| 4519 | 5 | 79538367 | 84340523 |
| 4520 | 5 | 79538367 | 84516340 |
| 4521 | 5 | 79538367 | 84706916 |
| 4522 | 5 | 79538367 | 84799488 |
| 4523 | 5 | 79538367 | 84801081 |
| 4524 | 5 | 79538367 | 84824103 |
| 4525 | 5 | 79538367 | 84824203 |
| 4526 | 5 | 79538367 | 84824816 |
| 4527 | 5 | 79538367 | 84825422 |
| 4528 | 5 | 79538367 | 84825763 |
| 4529 | 5 | 79538367 | 84825942 |
| 4530 | 5 | 79538367 | 84843411 |
| 4531 | 5 | 79538367 | 84936441 |
| 4532 | 5 | 79538367 | 84936493 |
| 4533 | 5 | 79538367 | 84943705 |
| 4534 | 5 | 79538367 | 169454950 |
| 4535 | 5 | 79538367 | 181522829 |
| 4536 | 5 | 79538367 | 204759879 |
| 4537 | 5 | 79538367 | 209874191 |
| 4538 | 5 | 79666742 | 79538367 |
| 4539 | 5 | 79666742 | 79669824 |
| 4540 | 5 | 79666742 | 79682242 |
| 4541 | 5 | 79666742 | 79699261 |
| 4542 | 5 | 79666742 | 79710673 |
| 4543 | 5 | 79666742 | 79861902 |
| 4544 | 5 | 79666742 | 79867710 |
| 4545 | 5 | 79666742 | 79867868 |
| 4546 | 5 | 79666742 | 79867873 |
| 4547 | 5 | 79666742 | 79961961 |
| 4548 | 5 | 79666742 | 80086268 |
| 4549 | 5 | 79666742 | 80190673 |
| 4550 | 5 | 79666742 | 80190777 |
| 4551 | 5 | 79666742 | 80192546 |
| 4552 | 5 | 79666742 | 80195395 |
| 4553 | 5 | 79666742 | 80199923 |
| 4554 | 5 | 79666742 | 80241911 |
| 4555 | 5 | 79666742 | 80282785 |
| 4556 | 5 | 79666742 | 80345337 |
| 4557 | 5 | 79666742 | 80389787 |
| 4558 | 5 | 79666742 | 80411639 |
| 4559 | 5 | 79666742 | 80446855 |
| 4560 | 5 | 79666742 | 80492790 |
| 4561 | 5 | 79666742 | 80670554 |
| 4562 | 5 | 79666742 | 80674679 |
| 4563 | 5 | 79666742 | 80720509 |
| 4564 | 5 | 79666742 | 80800856 |
| 4565 | 5 | 79666742 | 80804587 |
| 4566 | 5 | 79666742 | 80807409 |
| 4567 | 5 | 79666742 | 80835734 |
| 4568 | 5 | 79666742 | 80971764 |
| 4569 | 5 | 79666742 | 80972258 |
| 4570 | 5 | 79666742 | 80974450 |
| 4571 | 5 | 79666742 | 81047638 |
| 4572 | 5 | 79666742 | 81082921 |
| 4573 | 5 | 79666742 | 81157909 |
| 4574 | 5 | 79666742 | 81265937 |
| 4575 | 5 | 79666742 | 81265937 |
| 4576 | 5 | 79666742 | 81267485 |
| 4577 | 5 | 79666742 | 81267499 |
| 4578 | 5 | 79666742 | 81274512 |
| 4579 | 5 | 79666742 | 81763618 |
| 4580 | 5 | 79666742 | 81797217 |
| 4581 | 5 | 79666742 | 81800186 |
| 4582 | 5 | 79666742 | 81806213 |
| 4583 | 5 | 79666742 | 81854583 |
| 4584 | 5 | 79666742 | 81859374 |
| 4585 | 5 | 79666742 | 81861368 |
| 4586 | 5 | 79666742 | 81863686 |
| 4587 | 5 | 79666742 | 81916850 |
| 4588 | 5 | 79666742 | 81954891 |
| 4589 | 5 | 79666742 | 81985250 |
| 4590 | 5 | 79666742 | 82083752 |
| 4591 | 5 | 79666742 | 82101253 |
| 4592 | 5 | 79666742 | 82143124 |
| 4593 | 5 | 79666742 | 82236318 |
| 4594 | 5 | 79666742 | 82325587 |
| 4595 | 5 | 79666742 | 82427210 |
| 4596 | 5 | 79666742 | 82431853 |
| 4597 | 5 | 79666742 | 82446714 |
| 4598 | 5 | 79666742 | 82446794 |
| 4599 | 5 | 79666742 | 82551111 |
| 4600 | 5 | 79666742 | 82552090 |
| 4601 | 5 | 79666742 | 82555641 |
| 4602 | 5 | 79666742 | 82555670 |
| 4603 | 5 | 79666742 | 82556511 |
| 4604 | 5 | 79666742 | 82559047 |
| 4605 | 5 | 79666742 | 82561535 |
| 4606 | 5 | 79666742 | 82610100 |
| 4607 | 5 | 79666742 | 82676822 |
| 4608 | 5 | 79666742 | 82676901 |
| 4609 | 5 | 79666742 | 82883691 |
| 4610 | 5 | 79666742 | 82954942 |
| 4611 | 5 | 79666742 | 82971688 |
| 4612 | 5 | 79666742 | 83023965 |
| 4613 | 5 | 79666742 | 83094205 |
| 4614 | 5 | 79666742 | 83146355 |
| 4615 | 5 | 79666742 | 83280630 |
| 4616 | 5 | 79666742 | 83281412 |
| 4617 | 5 | 79666742 | 83400242 |
| 4618 | 5 | 79666742 | 83405797 |
| 4619 | 5 | 79666742 | 83437132 |
| 4620 | 5 | 79666742 | 83522252 |
| 4621 | 5 | 79666742 | 83560095 |
| 4622 | 5 | 79666742 | 83560204 |
| 4623 | 5 | 79666742 | 83572400 |
| 4624 | 5 | 79666742 | 83607661 |
| 4625 | 5 | 79666742 | 83745342 |
| 4626 | 5 | 79666742 | 83861275 |
| 4627 | 5 | 79666742 | 83861633 |
| 4628 | 5 | 79666742 | 83865653 |
| 4629 | 5 | 79666742 | 83865914 |
| 4630 | 5 | 79666742 | 83865920 |
| 4631 | 5 | 79666742 | 83868010 |
| 4632 | 5 | 79666742 | 84019752 |
| 4633 | 5 | 79666742 | 84065912 |
| 4634 | 5 | 79666742 | 84086632 |
| 4635 | 5 | 79666742 | 84089603 |
| 4636 | 5 | 79666742 | 84104814 |
| 4637 | 5 | 79666742 | 84105175 |
| 4638 | 5 | 79666742 | 84251635 |

TABLE 1-continued

Examples of chromosomal segments associated with increased fertility in maize.

| Chromosomal Segment | Chr. | Boundary 1 | Boundary 2 |
|---|---|---|---|
| 4639 | 5 | 79666742 | 84252180 |
| 4640 | 5 | 79666742 | 84253030 |
| 4641 | 5 | 79666742 | 84254208 |
| 4642 | 5 | 79666742 | 84314930 |
| 4643 | 5 | 79666742 | 84340523 |
| 4644 | 5 | 79666742 | 84516340 |
| 4645 | 5 | 79666742 | 84706916 |
| 4646 | 5 | 79666742 | 84799488 |
| 4647 | 5 | 79666742 | 84801081 |
| 4648 | 5 | 79666742 | 84824103 |
| 4649 | 5 | 79666742 | 84824203 |
| 4650 | 5 | 79666742 | 84824816 |
| 4651 | 5 | 79666742 | 84825422 |
| 4652 | 5 | 79666742 | 84825763 |
| 4653 | 5 | 79666742 | 84825942 |
| 4654 | 5 | 79666742 | 84843411 |
| 4655 | 5 | 79666742 | 84936441 |
| 4656 | 5 | 79666742 | 84936493 |
| 4657 | 5 | 79666742 | 84943705 |
| 4658 | 5 | 79666742 | 169454950 |
| 4659 | 5 | 79666742 | 181522829 |
| 4660 | 5 | 79666742 | 204759879 |
| 4661 | 5 | 79666742 | 209874191 |
| 4662 | 5 | 79679654 | 79682242 |
| 4663 | 5 | 79679654 | 79699261 |
| 4664 | 5 | 79679654 | 79710673 |
| 4665 | 5 | 79679654 | 79861902 |
| 4666 | 5 | 79679654 | 79867710 |
| 4667 | 5 | 79679654 | 79867868 |
| 4668 | 5 | 79679654 | 79867873 |
| 4669 | 5 | 79679654 | 79961961 |
| 4670 | 5 | 79679654 | 80086268 |
| 4671 | 5 | 79679654 | 80190673 |
| 4672 | 5 | 79679654 | 80190777 |
| 4673 | 5 | 79679654 | 80192546 |
| 4674 | 5 | 79679654 | 80195395 |
| 4675 | 5 | 79679654 | 80199923 |
| 4676 | 5 | 79679654 | 80241911 |
| 4677 | 5 | 79679654 | 80282785 |
| 4678 | 5 | 79679654 | 80345337 |
| 4679 | 5 | 79679654 | 80389787 |
| 4680 | 5 | 79679654 | 80411639 |
| 4681 | 5 | 79679654 | 80446855 |
| 4682 | 5 | 79679654 | 80492790 |
| 4683 | 5 | 79679654 | 80670554 |
| 4684 | 5 | 79679654 | 80674679 |
| 4685 | 5 | 79679654 | 80720509 |
| 4686 | 5 | 79679654 | 80800856 |
| 4687 | 5 | 79679654 | 80804587 |
| 4688 | 5 | 79679654 | 80807409 |
| 4689 | 5 | 79679654 | 80835734 |
| 4690 | 5 | 79679654 | 80971764 |
| 4691 | 5 | 79679654 | 80972258 |
| 4692 | 5 | 79679654 | 80974450 |
| 4693 | 5 | 79679654 | 81047638 |
| 4694 | 5 | 79679654 | 81082921 |
| 4695 | 5 | 79679654 | 81157909 |
| 4696 | 5 | 79679654 | 81265937 |
| 4697 | 5 | 79679654 | 81265937 |
| 4698 | 5 | 79679654 | 81267485 |
| 4699 | 5 | 79679654 | 81267499 |
| 4700 | 5 | 79679654 | 81274512 |
| 4701 | 5 | 79679654 | 81763618 |
| 4702 | 5 | 79679654 | 81797217 |
| 4703 | 5 | 79679654 | 81800186 |
| 4704 | 5 | 79679654 | 81806213 |
| 4705 | 5 | 79679654 | 81854583 |
| 4706 | 5 | 79679654 | 81859374 |
| 4707 | 5 | 79679654 | 81861368 |
| 4708 | 5 | 79679654 | 81863686 |
| 4709 | 5 | 79679654 | 81916850 |
| 4710 | 5 | 79679654 | 81954891 |
| 4711 | 5 | 79679654 | 81985250 |
| 4712 | 5 | 79679654 | 82083752 |
| 4713 | 5 | 79679654 | 82101253 |
| 4714 | 5 | 79679654 | 82143124 |
| 4715 | 5 | 79679654 | 82236318 |
| 4716 | 5 | 79679654 | 82325587 |
| 4717 | 5 | 79679654 | 82427210 |
| 4718 | 5 | 79679654 | 82431853 |
| 4719 | 5 | 79679654 | 82446714 |
| 4720 | 5 | 79679654 | 82446794 |
| 4721 | 5 | 79679654 | 82551111 |
| 4722 | 5 | 79679654 | 82552090 |
| 4723 | 5 | 79679654 | 82555641 |
| 4724 | 5 | 79679654 | 82555670 |
| 4725 | 5 | 79679654 | 82556511 |
| 4726 | 5 | 79679654 | 82559047 |
| 4727 | 5 | 79679654 | 82561535 |
| 4728 | 5 | 79679654 | 82610100 |
| 4729 | 5 | 79679654 | 82676822 |
| 4730 | 5 | 79679654 | 82676901 |
| 4731 | 5 | 79679654 | 82883691 |
| 4732 | 5 | 79679654 | 82954942 |
| 4733 | 5 | 79679654 | 82971688 |
| 4734 | 5 | 79679654 | 83023965 |
| 4735 | 5 | 79679654 | 83094205 |
| 4736 | 5 | 79679654 | 83146355 |
| 4737 | 5 | 79679654 | 83280630 |
| 4738 | 5 | 79679654 | 83281412 |
| 4739 | 5 | 79679654 | 83400242 |
| 4740 | 5 | 79679654 | 83405797 |
| 4741 | 5 | 79679654 | 83437132 |
| 4742 | 5 | 79679654 | 83522252 |
| 4743 | 5 | 79679654 | 83560095 |
| 4744 | 5 | 79679654 | 83560204 |
| 4745 | 5 | 79679654 | 83572400 |
| 4746 | 5 | 79679654 | 83607661 |
| 4747 | 5 | 79679654 | 83745342 |
| 4748 | 5 | 79679654 | 83861275 |
| 4749 | 5 | 79679654 | 83861633 |
| 4750 | 5 | 79679654 | 83865653 |
| 4751 | 5 | 79679654 | 83865914 |
| 4752 | 5 | 79679654 | 83865920 |
| 4753 | 5 | 79679654 | 83868010 |
| 4754 | 5 | 79679654 | 84019752 |
| 4755 | 5 | 79679654 | 84065912 |
| 4756 | 5 | 79679654 | 84086632 |
| 4757 | 5 | 79679654 | 84089603 |
| 4758 | 5 | 79679654 | 84104814 |
| 4759 | 5 | 79679654 | 84105175 |
| 4760 | 5 | 79679654 | 84251635 |
| 4761 | 5 | 79679654 | 84252180 |
| 4762 | 5 | 79679654 | 84253030 |
| 4763 | 5 | 79679654 | 84254208 |
| 4764 | 5 | 79679654 | 84314930 |
| 4765 | 5 | 79679654 | 84340523 |
| 4766 | 5 | 79679654 | 84516340 |
| 4767 | 5 | 79679654 | 84706916 |
| 4768 | 5 | 79679654 | 84799488 |
| 4769 | 5 | 79679654 | 84801081 |
| 4770 | 5 | 79679654 | 84824103 |
| 4771 | 5 | 79679654 | 84824203 |
| 4772 | 5 | 79679654 | 84824816 |
| 4773 | 5 | 79679654 | 84825422 |
| 4774 | 5 | 79679654 | 84825763 |
| 4775 | 5 | 79679654 | 84825942 |
| 4776 | 5 | 79679654 | 84843411 |
| 4777 | 5 | 79679654 | 84936441 |
| 4778 | 5 | 79679654 | 84936493 |
| 4779 | 5 | 79679654 | 84943705 |
| 4780 | 5 | 79679654 | 169454950 |
| 4781 | 5 | 79679654 | 181522829 |
| 4782 | 5 | 79679654 | 204759879 |
| 4783 | 5 | 79679654 | 209874191 |
| 4784 | 5 | 79697555 | 79699261 |
| 4785 | 5 | 79697555 | 79710673 |
| 4786 | 5 | 79697555 | 79861902 |

TABLE 1-continued

Examples of chromosomal segments associated with increased fertility in maize.

| Chromosomal Segment | Chr. | Boundary 1 | Boundary 2 |
|---|---|---|---|
| 4787 | 5 | 79697555 | 79867710 |
| 4788 | 5 | 79697555 | 79867868 |
| 4789 | 5 | 79697555 | 79867873 |
| 4790 | 5 | 79697555 | 79961961 |
| 4791 | 5 | 79697555 | 80086268 |
| 4792 | 5 | 79697555 | 80190673 |
| 4793 | 5 | 79697555 | 80190777 |
| 4794 | 5 | 79697555 | 80192546 |
| 4795 | 5 | 79697555 | 80195395 |
| 4796 | 5 | 79697555 | 80199923 |
| 4797 | 5 | 79697555 | 80241911 |
| 4798 | 5 | 79697555 | 80282785 |
| 4799 | 5 | 79697555 | 80345337 |
| 4800 | 5 | 79697555 | 80389787 |
| 4801 | 5 | 79697555 | 80411639 |
| 4802 | 5 | 79697555 | 80446855 |
| 4803 | 5 | 79697555 | 80492790 |
| 4804 | 5 | 79697555 | 80670554 |
| 4805 | 5 | 79697555 | 80674679 |
| 4806 | 5 | 79697555 | 80720509 |
| 4807 | 5 | 79697555 | 80800856 |
| 4808 | 5 | 79697555 | 80804587 |
| 4809 | 5 | 79697555 | 80807409 |
| 4810 | 5 | 79697555 | 80835734 |
| 4811 | 5 | 79697555 | 80971764 |
| 4812 | 5 | 79697555 | 80972258 |
| 4813 | 5 | 79697555 | 80974450 |
| 4814 | 5 | 79697555 | 81047638 |
| 4815 | 5 | 79697555 | 81082921 |
| 4816 | 5 | 79697555 | 81157909 |
| 4817 | 5 | 79697555 | 81265937 |
| 4818 | 5 | 79697555 | 81265937 |
| 4819 | 5 | 79697555 | 81267485 |
| 4820 | 5 | 79697555 | 81267499 |
| 4821 | 5 | 79697555 | 81274512 |
| 4822 | 5 | 79697555 | 81763618 |
| 4823 | 5 | 79697555 | 81797217 |
| 4824 | 5 | 79697555 | 81800186 |
| 4825 | 5 | 79697555 | 81806213 |
| 4826 | 5 | 79697555 | 81854583 |
| 4827 | 5 | 79697555 | 81859374 |
| 4828 | 5 | 79697555 | 81861368 |
| 4829 | 5 | 79697555 | 81863686 |
| 4830 | 5 | 79697555 | 81916850 |
| 4831 | 5 | 79697555 | 81954891 |
| 4832 | 5 | 79697555 | 81985250 |
| 4833 | 5 | 79697555 | 82083752 |
| 4834 | 5 | 79697555 | 82101253 |
| 4835 | 5 | 79697555 | 82143124 |
| 4836 | 5 | 79697555 | 82236318 |
| 4837 | 5 | 79697555 | 82325587 |
| 4838 | 5 | 79697555 | 82427210 |
| 4839 | 5 | 79697555 | 82431853 |
| 4840 | 5 | 79697555 | 82446714 |
| 4841 | 5 | 79697555 | 82446794 |
| 4842 | 5 | 79697555 | 82551111 |
| 4843 | 5 | 79697555 | 82552090 |
| 4844 | 5 | 79697555 | 82555641 |
| 4845 | 5 | 79697555 | 82555670 |
| 4846 | 5 | 79697555 | 82556511 |
| 4847 | 5 | 79697555 | 82559047 |
| 4848 | 5 | 79697555 | 82561535 |
| 4849 | 5 | 79697555 | 82610100 |
| 4850 | 5 | 79697555 | 82676822 |
| 4851 | 5 | 79697555 | 82676901 |
| 4852 | 5 | 79697555 | 82883691 |
| 4853 | 5 | 79697555 | 82954942 |
| 4854 | 5 | 79697555 | 82971688 |
| 4855 | 5 | 79697555 | 83023965 |
| 4856 | 5 | 79697555 | 83094205 |
| 4857 | 5 | 79697555 | 83146355 |
| 4858 | 5 | 79697555 | 83280630 |
| 4859 | 5 | 79697555 | 83281412 |
| 4860 | 5 | 79697555 | 83400242 |
| 4861 | 5 | 79697555 | 83405797 |
| 4862 | 5 | 79697555 | 83437132 |
| 4863 | 5 | 79697555 | 83522252 |
| 4864 | 5 | 79697555 | 83560095 |
| 4865 | 5 | 79697555 | 83560204 |
| 4866 | 5 | 79697555 | 83572400 |
| 4867 | 5 | 79697555 | 83607661 |
| 4868 | 5 | 79697555 | 83745342 |
| 4869 | 5 | 79697555 | 83861275 |
| 4870 | 5 | 79697555 | 83861633 |
| 4871 | 5 | 79697555 | 83865653 |
| 4872 | 5 | 79697555 | 83865914 |
| 4873 | 5 | 79697555 | 83865920 |
| 4874 | 5 | 79697555 | 83868010 |
| 4875 | 5 | 79697555 | 84019752 |
| 4876 | 5 | 79697555 | 84065912 |
| 4877 | 5 | 79697555 | 84086632 |
| 4878 | 5 | 79697555 | 84089603 |
| 4879 | 5 | 79697555 | 84104814 |
| 4880 | 5 | 79697555 | 84105175 |
| 4881 | 5 | 79697555 | 84251635 |
| 4882 | 5 | 79697555 | 84252180 |
| 4883 | 5 | 79697555 | 84253030 |
| 4884 | 5 | 79697555 | 84254208 |
| 4885 | 5 | 79697555 | 84314930 |
| 4886 | 5 | 79697555 | 84340523 |
| 4887 | 5 | 79697555 | 84516340 |
| 4888 | 5 | 79697555 | 84706916 |
| 4889 | 5 | 79697555 | 84799488 |
| 4890 | 5 | 79697555 | 84801081 |
| 4891 | 5 | 79697555 | 84824103 |
| 4892 | 5 | 79697555 | 84824203 |
| 4893 | 5 | 79697555 | 84824816 |
| 4894 | 5 | 79697555 | 84825422 |
| 4895 | 5 | 79697555 | 84825763 |
| 4896 | 5 | 79697555 | 84825942 |
| 4897 | 5 | 79697555 | 84843411 |
| 4898 | 5 | 79697555 | 84936441 |
| 4899 | 5 | 79697555 | 84936493 |
| 4900 | 5 | 79697555 | 84943705 |
| 4901 | 5 | 79697555 | 169454950 |
| 4902 | 5 | 79697555 | 181522829 |
| 4903 | 5 | 79697555 | 204759879 |
| 4904 | 5 | 79697555 | 209874191 |
| 4905 | 5 | 79857859 | 79861902 |
| 4906 | 5 | 79857859 | 79867710 |
| 4907 | 5 | 79857859 | 79867868 |
| 4908 | 5 | 79857859 | 79867873 |
| 4909 | 5 | 79857859 | 79961961 |
| 4910 | 5 | 79857859 | 80086268 |
| 4911 | 5 | 79857859 | 80190673 |
| 4912 | 5 | 79857859 | 80190777 |
| 4913 | 5 | 79857859 | 80192546 |
| 4914 | 5 | 79857859 | 80195395 |
| 4915 | 5 | 79857859 | 80199923 |
| 4916 | 5 | 79857859 | 80241911 |
| 4917 | 5 | 79857859 | 80282785 |
| 4918 | 5 | 79857859 | 80345337 |
| 4919 | 5 | 79857859 | 80389787 |
| 4920 | 5 | 79857859 | 80411639 |
| 4921 | 5 | 79857859 | 80446855 |
| 4922 | 5 | 79857859 | 80492790 |
| 4923 | 5 | 79857859 | 80670554 |
| 4924 | 5 | 79857859 | 80674679 |
| 4925 | 5 | 79857859 | 80720509 |
| 4926 | 5 | 79857859 | 80800856 |
| 4927 | 5 | 79857859 | 80804587 |
| 4928 | 5 | 79857859 | 80807409 |
| 4929 | 5 | 79857859 | 80835734 |
| 4930 | 5 | 79857859 | 80971764 |
| 4931 | 5 | 79857859 | 80972258 |
| 4932 | 5 | 79857859 | 80974450 |
| 4933 | 5 | 79857859 | 81047638 |
| 4934 | 5 | 79857859 | 81082921 |

TABLE 1-continued

Examples of chromosomal segments associated with increased fertility in maize.

| Chromosomal Segment | Chr. | Boundary 1 | Boundary 2 |
|---|---|---|---|
| 4935 | 5 | 79857859 | 81157909 |
| 4936 | 5 | 79857859 | 81265937 |
| 4937 | 5 | 79857859 | 81265937 |
| 4938 | 5 | 79857859 | 81267485 |
| 4939 | 5 | 79857859 | 81267499 |
| 4940 | 5 | 79857859 | 81274512 |
| 4941 | 5 | 79857859 | 81763618 |
| 4942 | 5 | 79857859 | 81797217 |
| 4943 | 5 | 79857859 | 81800186 |
| 4944 | 5 | 79857859 | 81806213 |
| 4945 | 5 | 79857859 | 81854583 |
| 4946 | 5 | 79857859 | 81859374 |
| 4947 | 5 | 79857859 | 81861368 |
| 4948 | 5 | 79857859 | 81863686 |
| 4949 | 5 | 79857859 | 81916850 |
| 4950 | 5 | 79857859 | 81954891 |
| 4951 | 5 | 79857859 | 81985250 |
| 4952 | 5 | 79857859 | 82083752 |
| 4953 | 5 | 79857859 | 82101253 |
| 4954 | 5 | 79857859 | 82143124 |
| 4955 | 5 | 79857859 | 82236318 |
| 4956 | 5 | 79857859 | 82325587 |
| 4957 | 5 | 79857859 | 82427210 |
| 4958 | 5 | 79857859 | 82431853 |
| 4959 | 5 | 79857859 | 82446714 |
| 4960 | 5 | 79857859 | 82446794 |
| 4961 | 5 | 79857859 | 82551111 |
| 4962 | 5 | 79857859 | 82552090 |
| 4963 | 5 | 79857859 | 82555641 |
| 4964 | 5 | 79857859 | 82555670 |
| 4965 | 5 | 79857859 | 82556511 |
| 4966 | 5 | 79857859 | 82559047 |
| 4967 | 5 | 79857859 | 82561535 |
| 4968 | 5 | 79857859 | 82610100 |
| 4969 | 5 | 79857859 | 82676822 |
| 4970 | 5 | 79857859 | 82676901 |
| 4971 | 5 | 79857859 | 82883691 |
| 4972 | 5 | 79857859 | 82954942 |
| 4973 | 5 | 79857859 | 82971688 |
| 4974 | 5 | 79857859 | 83023965 |
| 4975 | 5 | 79857859 | 83094205 |
| 4976 | 5 | 79857859 | 83146355 |
| 4977 | 5 | 79857859 | 83280630 |
| 4978 | 5 | 79857859 | 83281412 |
| 4979 | 5 | 79857859 | 83400242 |
| 4980 | 5 | 79857859 | 83405797 |
| 4981 | 5 | 79857859 | 83437132 |
| 4982 | 5 | 79857859 | 83522252 |
| 4983 | 5 | 79857859 | 83560095 |
| 4984 | 5 | 79857859 | 83560204 |
| 4985 | 5 | 79857859 | 83572400 |
| 4986 | 5 | 79857859 | 83607661 |
| 4987 | 5 | 79857859 | 83745342 |
| 4988 | 5 | 79857859 | 83861275 |
| 4989 | 5 | 79857859 | 83861633 |
| 4990 | 5 | 79857859 | 83865653 |
| 4991 | 5 | 79857859 | 83865914 |
| 4992 | 5 | 79857859 | 83865920 |
| 4993 | 5 | 79857859 | 83868010 |
| 4994 | 5 | 79857859 | 84019752 |
| 4995 | 5 | 79857859 | 84065912 |
| 4996 | 5 | 79857859 | 84086632 |
| 4997 | 5 | 79857859 | 84089603 |
| 4998 | 5 | 79857859 | 84104814 |
| 4999 | 5 | 79857859 | 84105175 |
| 5000 | 5 | 79857859 | 84251635 |
| 5001 | 5 | 79857859 | 84252180 |
| 5002 | 5 | 79857859 | 84253030 |
| 5003 | 5 | 79857859 | 84254208 |
| 5004 | 5 | 79857859 | 84314930 |
| 5005 | 5 | 79857859 | 84340523 |
| 5006 | 5 | 79857859 | 84516340 |
| 5007 | 5 | 79857859 | 84706916 |
| 5008 | 5 | 79857859 | 84799488 |
| 5009 | 5 | 79857859 | 84801081 |
| 5010 | 5 | 79857859 | 84824103 |
| 5011 | 5 | 79857859 | 84824203 |
| 5012 | 5 | 79857859 | 84824816 |
| 5013 | 5 | 79857859 | 84825422 |
| 5014 | 5 | 79857859 | 84825763 |
| 5015 | 5 | 79857859 | 84825942 |
| 5016 | 5 | 79857859 | 84843411 |
| 5017 | 5 | 79857859 | 84936441 |
| 5018 | 5 | 79857859 | 84936493 |
| 5019 | 5 | 79857859 | 84943705 |
| 5020 | 5 | 79857859 | 169454950 |
| 5021 | 5 | 79857859 | 181522829 |
| 5022 | 5 | 79857859 | 204759879 |
| 5023 | 5 | 79857859 | 209874191 |
| 5024 | 5 | 79862405 | 79867710 |
| 5025 | 5 | 79862405 | 79867868 |
| 5026 | 5 | 79862405 | 79867873 |
| 5027 | 5 | 79862405 | 79961961 |
| 5028 | 5 | 79862405 | 80086268 |
| 5029 | 5 | 79862405 | 80190673 |
| 5030 | 5 | 79862405 | 80190777 |
| 5031 | 5 | 79862405 | 80192546 |
| 5032 | 5 | 79862405 | 80195395 |
| 5033 | 5 | 79862405 | 80199923 |
| 5034 | 5 | 79862405 | 80241911 |
| 5035 | 5 | 79862405 | 80282785 |
| 5036 | 5 | 79862405 | 80345337 |
| 5037 | 5 | 79862405 | 80389787 |
| 5038 | 5 | 79862405 | 80411639 |
| 5039 | 5 | 79862405 | 80446855 |
| 5040 | 5 | 79862405 | 80492790 |
| 5041 | 5 | 79862405 | 80670554 |
| 5042 | 5 | 79862405 | 80674679 |
| 5043 | 5 | 79862405 | 80720509 |
| 5044 | 5 | 79862405 | 80800856 |
| 5045 | 5 | 79862405 | 80804587 |
| 5046 | 5 | 79862405 | 80807409 |
| 5047 | 5 | 79862405 | 80835734 |
| 5048 | 5 | 79862405 | 80971764 |
| 5049 | 5 | 79862405 | 80972258 |
| 5050 | 5 | 79862405 | 80974450 |
| 5051 | 5 | 79862405 | 81047638 |
| 5052 | 5 | 79862405 | 81082921 |
| 5053 | 5 | 79862405 | 81157909 |
| 5054 | 5 | 79862405 | 81265937 |
| 5055 | 5 | 79862405 | 81265937 |
| 5056 | 5 | 79862405 | 81267485 |
| 5057 | 5 | 79862405 | 81267499 |
| 5058 | 5 | 79862405 | 81274512 |
| 5059 | 5 | 79862405 | 81763618 |
| 5060 | 5 | 79862405 | 81797217 |
| 5061 | 5 | 79862405 | 81800186 |
| 5062 | 5 | 79862405 | 81806213 |
| 5063 | 5 | 79862405 | 81854583 |
| 5064 | 5 | 79862405 | 81859374 |
| 5065 | 5 | 79862405 | 81861368 |
| 5066 | 5 | 79862405 | 81863686 |
| 5067 | 5 | 79862405 | 81916850 |
| 5068 | 5 | 79862405 | 81954891 |
| 5069 | 5 | 79862405 | 81985250 |
| 5070 | 5 | 79862405 | 82083752 |
| 5071 | 5 | 79862405 | 82101253 |
| 5072 | 5 | 79862405 | 82143124 |
| 5073 | 5 | 79862405 | 82236318 |
| 5074 | 5 | 79862405 | 82325587 |
| 5075 | 5 | 79862405 | 82427210 |
| 5076 | 5 | 79862405 | 82431853 |
| 5077 | 5 | 79862405 | 82446714 |
| 5078 | 5 | 79862405 | 82446794 |
| 5079 | 5 | 79862405 | 82551111 |
| 5080 | 5 | 79862405 | 82552090 |
| 5081 | 5 | 79862405 | 82555641 |
| 5082 | 5 | 79862405 | 82555670 |

TABLE 1-continued

Examples of chromosomal segments associated with increased fertility in maize.

| Chromosomal Segment | Chr. | Boundary 1 | Boundary 2 |
|---|---|---|---|
| 5083 | 5 | 79862405 | 82556511 |
| 5084 | 5 | 79862405 | 82559047 |
| 5085 | 5 | 79862405 | 82561535 |
| 5086 | 5 | 79862405 | 82610100 |
| 5087 | 5 | 79862405 | 82676822 |
| 5088 | 5 | 79862405 | 82676901 |
| 5089 | 5 | 79862405 | 82883691 |
| 5090 | 5 | 79862405 | 82954942 |
| 5091 | 5 | 79862405 | 82971688 |
| 5092 | 5 | 79862405 | 83023965 |
| 5093 | 5 | 79862405 | 83094205 |
| 5094 | 5 | 79862405 | 83146355 |
| 5095 | 5 | 79862405 | 83280630 |
| 5096 | 5 | 79862405 | 83281412 |
| 5097 | 5 | 79862405 | 83400242 |
| 5098 | 5 | 79862405 | 83405797 |
| 5099 | 5 | 79862405 | 83437132 |
| 5100 | 5 | 79862405 | 83522252 |
| 5101 | 5 | 79862405 | 83560095 |
| 5102 | 5 | 79862405 | 83560204 |
| 5103 | 5 | 79862405 | 83572400 |
| 5104 | 5 | 79862405 | 83607661 |
| 5105 | 5 | 79862405 | 83745342 |
| 5106 | 5 | 79862405 | 83861275 |
| 5107 | 5 | 79862405 | 83861633 |
| 5108 | 5 | 79862405 | 83865653 |
| 5109 | 5 | 79862405 | 83865914 |
| 5110 | 5 | 79862405 | 83865920 |
| 5111 | 5 | 79862405 | 83868010 |
| 5112 | 5 | 79862405 | 84019752 |
| 5113 | 5 | 79862405 | 84065912 |
| 5114 | 5 | 79862405 | 84086632 |
| 5115 | 5 | 79862405 | 84089603 |
| 5116 | 5 | 79862405 | 84104814 |
| 5117 | 5 | 79862405 | 84105175 |
| 5118 | 5 | 79862405 | 84251635 |
| 5119 | 5 | 79862405 | 84252180 |
| 5120 | 5 | 79862405 | 84253030 |
| 5121 | 5 | 79862405 | 84254208 |
| 5122 | 5 | 79862405 | 84314930 |
| 5123 | 5 | 79862405 | 84340523 |
| 5124 | 5 | 79862405 | 84516340 |
| 5125 | 5 | 79862405 | 84706916 |
| 5126 | 5 | 79862405 | 84799488 |
| 5127 | 5 | 79862405 | 84801081 |
| 5128 | 5 | 79862405 | 84824103 |
| 5129 | 5 | 79862405 | 84824203 |
| 5130 | 5 | 79862405 | 84824816 |
| 5131 | 5 | 79862405 | 84825422 |
| 5132 | 5 | 79862405 | 84825763 |
| 5133 | 5 | 79862405 | 84825942 |
| 5134 | 5 | 79862405 | 84843411 |
| 5135 | 5 | 79862405 | 84936441 |
| 5136 | 5 | 79862405 | 84936493 |
| 5137 | 5 | 79862405 | 84943705 |
| 5138 | 5 | 79862405 | 169454950 |
| 5139 | 5 | 79862405 | 181522829 |
| 5140 | 5 | 79862405 | 204759879 |
| 5141 | 5 | 79862405 | 209874191 |
| 5142 | 5 | 79960831 | 79961961 |
| 5143 | 5 | 79960831 | 80086268 |
| 5144 | 5 | 79960831 | 80190673 |
| 5145 | 5 | 79960831 | 80190777 |
| 5146 | 5 | 79960831 | 80192546 |
| 5147 | 5 | 79960831 | 80195395 |
| 5148 | 5 | 79960831 | 80199923 |
| 5149 | 5 | 79960831 | 80241911 |
| 5150 | 5 | 79960831 | 80282785 |
| 5151 | 5 | 79960831 | 80345337 |
| 5152 | 5 | 79960831 | 80389787 |
| 5153 | 5 | 79960831 | 80411639 |
| 5154 | 5 | 79960831 | 80446855 |
| 5155 | 5 | 79960831 | 80492790 |
| 5156 | 5 | 79960831 | 80670554 |
| 5157 | 5 | 79960831 | 80674679 |
| 5158 | 5 | 79960831 | 80720509 |
| 5159 | 5 | 79960831 | 80800856 |
| 5160 | 5 | 79960831 | 80804587 |
| 5161 | 5 | 79960831 | 80807409 |
| 5162 | 5 | 79960831 | 80835734 |
| 5163 | 5 | 79960831 | 80971764 |
| 5164 | 5 | 79960831 | 80972258 |
| 5165 | 5 | 79960831 | 80974450 |
| 5166 | 5 | 79960831 | 81047638 |
| 5167 | 5 | 79960831 | 81082921 |
| 5168 | 5 | 79960831 | 81157909 |
| 5169 | 5 | 79960831 | 81265937 |
| 5170 | 5 | 79960831 | 81265937 |
| 5171 | 5 | 79960831 | 81267485 |
| 5172 | 5 | 79960831 | 81267499 |
| 5173 | 5 | 79960831 | 81274512 |
| 5174 | 5 | 79960831 | 81763618 |
| 5175 | 5 | 79960831 | 81797217 |
| 5176 | 5 | 79960831 | 81800186 |
| 5177 | 5 | 79960831 | 81806213 |
| 5178 | 5 | 79960831 | 81854583 |
| 5179 | 5 | 79960831 | 81859374 |
| 5180 | 5 | 79960831 | 81861368 |
| 5181 | 5 | 79960831 | 81863686 |
| 5182 | 5 | 79960831 | 81916850 |
| 5183 | 5 | 79960831 | 81954891 |
| 5184 | 5 | 79960831 | 81985250 |
| 5185 | 5 | 79960831 | 82083752 |
| 5186 | 5 | 79960831 | 82101253 |
| 5187 | 5 | 79960831 | 82143124 |
| 5188 | 5 | 79960831 | 82236318 |
| 5189 | 5 | 79960831 | 82325587 |
| 5190 | 5 | 79960831 | 82427210 |
| 5191 | 5 | 79960831 | 82431853 |
| 5192 | 5 | 79960831 | 82446714 |
| 5193 | 5 | 79960831 | 82446794 |
| 5194 | 5 | 79960831 | 82551111 |
| 5195 | 5 | 79960831 | 82552090 |
| 5196 | 5 | 79960831 | 82555641 |
| 5197 | 5 | 79960831 | 82555670 |
| 5198 | 5 | 79960831 | 82556511 |
| 5199 | 5 | 79960831 | 82559047 |
| 5200 | 5 | 79960831 | 82561535 |
| 5201 | 5 | 79960831 | 82610100 |
| 5202 | 5 | 79960831 | 82676822 |
| 5203 | 5 | 79960831 | 82676901 |
| 5204 | 5 | 79960831 | 82883691 |
| 5205 | 5 | 79960831 | 82954942 |
| 5206 | 5 | 79960831 | 82971688 |
| 5207 | 5 | 79960831 | 83023965 |
| 5208 | 5 | 79960831 | 83094205 |
| 5209 | 5 | 79960831 | 83146355 |
| 5210 | 5 | 79960831 | 83280630 |
| 5211 | 5 | 79960831 | 83281412 |
| 5212 | 5 | 79960831 | 83400242 |
| 5213 | 5 | 79960831 | 83405797 |
| 5214 | 5 | 79960831 | 83437132 |
| 5215 | 5 | 79960831 | 83522252 |
| 5216 | 5 | 79960831 | 83560095 |
| 5217 | 5 | 79960831 | 83560204 |
| 5218 | 5 | 79960831 | 83572400 |
| 5219 | 5 | 79960831 | 83607661 |
| 5220 | 5 | 79960831 | 83745342 |
| 5221 | 5 | 79960831 | 83861275 |
| 5222 | 5 | 79960831 | 83861633 |
| 5223 | 5 | 79960831 | 83865653 |
| 5224 | 5 | 79960831 | 83865914 |
| 5225 | 5 | 79960831 | 83865920 |
| 5226 | 5 | 79960831 | 83868010 |
| 5227 | 5 | 79960831 | 84019752 |
| 5228 | 5 | 79960831 | 84065912 |
| 5229 | 5 | 79960831 | 84086632 |
| 5230 | 5 | 79960831 | 84089603 |

TABLE 1-continued

Examples of chromosomal segments associated with increased fertility in maize.

| Chromosomal Segment | Chr. | Boundary 1 | Boundary 2 |
|---|---|---|---|
| 5231 | 5 | 79960831 | 84104814 |
| 5232 | 5 | 79960831 | 84105175 |
| 5233 | 5 | 79960831 | 84251635 |
| 5234 | 5 | 79960831 | 84252180 |
| 5235 | 5 | 79960831 | 84253030 |
| 5236 | 5 | 79960831 | 84254208 |
| 5237 | 5 | 79960831 | 84314930 |
| 5238 | 5 | 79960831 | 84340523 |
| 5239 | 5 | 79960831 | 84516340 |
| 5240 | 5 | 79960831 | 84706916 |
| 5241 | 5 | 79960831 | 84799488 |
| 5242 | 5 | 79960831 | 84801081 |
| 5243 | 5 | 79960831 | 84824103 |
| 5244 | 5 | 79960831 | 84824203 |
| 5245 | 5 | 79960831 | 84824816 |
| 5246 | 5 | 79960831 | 84825422 |
| 5247 | 5 | 79960831 | 84825763 |
| 5248 | 5 | 79960831 | 84825942 |
| 5249 | 5 | 79960831 | 84843411 |
| 5250 | 5 | 79960831 | 84936441 |
| 5251 | 5 | 79960831 | 84936493 |
| 5252 | 5 | 79960831 | 84943705 |
| 5253 | 5 | 79960831 | 169454950 |
| 5254 | 5 | 79960831 | 181522829 |
| 5255 | 5 | 79960831 | 204759879 |
| 5256 | 5 | 79960831 | 209874191 |
| 5257 | 5 | 80084956 | 80086268 |
| 5258 | 5 | 80084956 | 80190673 |
| 5259 | 5 | 80084956 | 80190777 |
| 5260 | 5 | 80084956 | 80192546 |
| 5261 | 5 | 80084956 | 80195395 |
| 5262 | 5 | 80084956 | 80199923 |
| 5263 | 5 | 80084956 | 80241911 |
| 5264 | 5 | 80084956 | 80282785 |
| 5265 | 5 | 80084956 | 80345337 |
| 5266 | 5 | 80084956 | 80389787 |
| 5267 | 5 | 80084956 | 80411639 |
| 5268 | 5 | 80084956 | 80446855 |
| 5269 | 5 | 80084956 | 80492790 |
| 5270 | 5 | 80084956 | 80670554 |
| 5271 | 5 | 80084956 | 80674679 |
| 5272 | 5 | 80084956 | 80720509 |
| 5273 | 5 | 80084956 | 80800856 |
| 5274 | 5 | 80084956 | 80804587 |
| 5275 | 5 | 80084956 | 80807409 |
| 5276 | 5 | 80084956 | 80835734 |
| 5277 | 5 | 80084956 | 80971764 |
| 5278 | 5 | 80084956 | 80972258 |
| 5279 | 5 | 80084956 | 80974450 |
| 5280 | 5 | 80084956 | 81047638 |
| 5281 | 5 | 80084956 | 81082921 |
| 5282 | 5 | 80084956 | 81157909 |
| 5283 | 5 | 80084956 | 81265937 |
| 5284 | 5 | 80084956 | 81265937 |
| 5285 | 5 | 80084956 | 81267485 |
| 5286 | 5 | 80084956 | 81267499 |
| 5287 | 5 | 80084956 | 81274512 |
| 5288 | 5 | 80084956 | 81763618 |
| 5289 | 5 | 80084956 | 81797217 |
| 5290 | 5 | 80084956 | 81800186 |
| 5291 | 5 | 80084956 | 81806213 |
| 5292 | 5 | 80084956 | 81854583 |
| 5293 | 5 | 80084956 | 81859374 |
| 5294 | 5 | 80084956 | 81861368 |
| 5295 | 5 | 80084956 | 81863686 |
| 5296 | 5 | 80084956 | 81916850 |
| 5297 | 5 | 80084956 | 81954891 |
| 5298 | 5 | 80084956 | 81985250 |
| 5299 | 5 | 80084956 | 82083752 |
| 5300 | 5 | 80084956 | 82101253 |
| 5301 | 5 | 80084956 | 82143124 |
| 5302 | 5 | 80084956 | 82236318 |
| 5303 | 5 | 80084956 | 82325587 |
| 5304 | 5 | 80084956 | 82427210 |
| 5305 | 5 | 80084956 | 82431853 |
| 5306 | 5 | 80084956 | 82446714 |
| 5307 | 5 | 80084956 | 82446794 |
| 5308 | 5 | 80084956 | 82551111 |
| 5309 | 5 | 80084956 | 82552090 |
| 5310 | 5 | 80084956 | 82555641 |
| 5311 | 5 | 80084956 | 82555670 |
| 5312 | 5 | 80084956 | 82556511 |
| 5313 | 5 | 80084956 | 82559047 |
| 5314 | 5 | 80084956 | 82561535 |
| 5315 | 5 | 80084956 | 82610100 |
| 5316 | 5 | 80084956 | 82676822 |
| 5317 | 5 | 80084956 | 82676901 |
| 5318 | 5 | 80084956 | 82883691 |
| 5319 | 5 | 80084956 | 82954942 |
| 5320 | 5 | 80084956 | 82971688 |
| 5321 | 5 | 80084956 | 83023965 |
| 5322 | 5 | 80084956 | 83094205 |
| 5323 | 5 | 80084956 | 83146355 |
| 5324 | 5 | 80084956 | 83280630 |
| 5325 | 5 | 80084956 | 83281412 |
| 5326 | 5 | 80084956 | 83400242 |
| 5327 | 5 | 80084956 | 83405797 |
| 5328 | 5 | 80084956 | 83437132 |
| 5329 | 5 | 80084956 | 83522252 |
| 5330 | 5 | 80084956 | 83560095 |
| 5331 | 5 | 80084956 | 83560204 |
| 5332 | 5 | 80084956 | 83572400 |
| 5333 | 5 | 80084956 | 83607661 |
| 5334 | 5 | 80084956 | 83745342 |
| 5335 | 5 | 80084956 | 83861275 |
| 5336 | 5 | 80084956 | 83861633 |
| 5337 | 5 | 80084956 | 83865653 |
| 5338 | 5 | 80084956 | 83865914 |
| 5339 | 5 | 80084956 | 83865920 |
| 5340 | 5 | 80084956 | 83868010 |
| 5341 | 5 | 80084956 | 84019752 |
| 5342 | 5 | 80084956 | 84065912 |
| 5343 | 5 | 80084956 | 84086632 |
| 5344 | 5 | 80084956 | 84089603 |
| 5345 | 5 | 80084956 | 84104814 |
| 5346 | 5 | 80084956 | 84105175 |
| 5347 | 5 | 80084956 | 84251635 |
| 5348 | 5 | 80084956 | 84252180 |
| 5349 | 5 | 80084956 | 84253030 |
| 5350 | 5 | 80084956 | 84254208 |
| 5351 | 5 | 80084956 | 84314930 |
| 5352 | 5 | 80084956 | 84340523 |
| 5353 | 5 | 80084956 | 84516340 |
| 5354 | 5 | 80084956 | 84706916 |
| 5355 | 5 | 80084956 | 84799488 |
| 5356 | 5 | 80084956 | 84801081 |
| 5357 | 5 | 80084956 | 84824103 |
| 5358 | 5 | 80084956 | 84824203 |
| 5359 | 5 | 80084956 | 84824816 |
| 5360 | 5 | 80084956 | 84825422 |
| 5361 | 5 | 80084956 | 84825763 |
| 5362 | 5 | 80084956 | 84825942 |
| 5363 | 5 | 80084956 | 84843411 |
| 5364 | 5 | 80084956 | 84936441 |
| 5365 | 5 | 80084956 | 84936493 |
| 5366 | 5 | 80084956 | 84943705 |
| 5367 | 5 | 80084956 | 169454950 |
| 5368 | 5 | 80084956 | 181522829 |
| 5369 | 5 | 80084956 | 204759879 |
| 5370 | 5 | 80084956 | 209874191 |
| 5371 | 5 | 80187987 | 80190673 |
| 5372 | 5 | 80187987 | 80190777 |
| 5373 | 5 | 80187987 | 80192546 |
| 5374 | 5 | 80187987 | 80195395 |
| 5375 | 5 | 80187987 | 80199923 |
| 5376 | 5 | 80187987 | 80241911 |
| 5377 | 5 | 80187987 | 80282785 |
| 5378 | 5 | 80187987 | 80345337 |

TABLE 1-continued

Examples of chromosomal segments associated with increased fertility in maize.

| Chromosomal Segment | Chr. | Boundary 1 | Boundary 2 |
|---|---|---|---|
| 5379 | 5 | 80187987 | 80389787 |
| 5380 | 5 | 80187987 | 80411639 |
| 5381 | 5 | 80187987 | 80446855 |
| 5382 | 5 | 80187987 | 80492790 |
| 5383 | 5 | 80187987 | 80670554 |
| 5384 | 5 | 80187987 | 80674679 |
| 5385 | 5 | 80187987 | 80720509 |
| 5386 | 5 | 80187987 | 80800856 |
| 5387 | 5 | 80187987 | 80804587 |
| 5388 | 5 | 80187987 | 80807409 |
| 5389 | 5 | 80187987 | 80835734 |
| 5390 | 5 | 80187987 | 80971764 |
| 5391 | 5 | 80187987 | 80972258 |
| 5392 | 5 | 80187987 | 80974450 |
| 5393 | 5 | 80187987 | 81047638 |
| 5394 | 5 | 80187987 | 81082921 |
| 5395 | 5 | 80187987 | 81157909 |
| 5396 | 5 | 80187987 | 81265937 |
| 5397 | 5 | 80187987 | 81265937 |
| 5398 | 5 | 80187987 | 81267485 |
| 5399 | 5 | 80187987 | 81267499 |
| 5400 | 5 | 80187987 | 81274512 |
| 5401 | 5 | 80187987 | 81763618 |
| 5402 | 5 | 80187987 | 81797217 |
| 5403 | 5 | 80187987 | 81800186 |
| 5404 | 5 | 80187987 | 81806213 |
| 5405 | 5 | 80187987 | 81854583 |
| 5406 | 5 | 80187987 | 81859374 |
| 5407 | 5 | 80187987 | 81861368 |
| 5408 | 5 | 80187987 | 81863686 |
| 5409 | 5 | 80187987 | 81916850 |
| 5410 | 5 | 80187987 | 81954891 |
| 5411 | 5 | 80187987 | 81985250 |
| 5412 | 5 | 80187987 | 82083752 |
| 5413 | 5 | 80187987 | 82101253 |
| 5414 | 5 | 80187987 | 82143124 |
| 5415 | 5 | 80187987 | 82236318 |
| 5416 | 5 | 80187987 | 82325587 |
| 5417 | 5 | 80187987 | 82427210 |
| 5418 | 5 | 80187987 | 82431853 |
| 5419 | 5 | 80187987 | 82446714 |
| 5420 | 5 | 80187987 | 82446794 |
| 5421 | 5 | 80187987 | 82551111 |
| 5422 | 5 | 80187987 | 82552090 |
| 5423 | 5 | 80187987 | 82555641 |
| 5424 | 5 | 80187987 | 82555670 |
| 5425 | 5 | 80187987 | 82556511 |
| 5426 | 5 | 80187987 | 82559047 |
| 5427 | 5 | 80187987 | 82561535 |
| 5428 | 5 | 80187987 | 82610100 |
| 5429 | 5 | 80187987 | 82676822 |
| 5430 | 5 | 80187987 | 82676901 |
| 5431 | 5 | 80187987 | 82883691 |
| 5432 | 5 | 80187987 | 82954942 |
| 5433 | 5 | 80187987 | 82971688 |
| 5434 | 5 | 80187987 | 83023965 |
| 5435 | 5 | 80187987 | 83094205 |
| 5436 | 5 | 80187987 | 83146355 |
| 5437 | 5 | 80187987 | 83280630 |
| 5438 | 5 | 80187987 | 83281412 |
| 5439 | 5 | 80187987 | 83400242 |
| 5440 | 5 | 80187987 | 83405797 |
| 5441 | 5 | 80187987 | 83437132 |
| 5442 | 5 | 80187987 | 83522252 |
| 5443 | 5 | 80187987 | 83560095 |
| 5444 | 5 | 80187987 | 83560204 |
| 5445 | 5 | 80187987 | 83572400 |
| 5446 | 5 | 80187987 | 83607661 |
| 5447 | 5 | 80187987 | 83745342 |
| 5448 | 5 | 80187987 | 83861275 |
| 5449 | 5 | 80187987 | 83861633 |
| 5450 | 5 | 80187987 | 83865653 |
| 5451 | 5 | 80187987 | 83865914 |
| 5452 | 5 | 80187987 | 83865920 |
| 5453 | 5 | 80187987 | 83868010 |
| 5454 | 5 | 80187987 | 84019752 |
| 5455 | 5 | 80187987 | 84065912 |
| 5456 | 5 | 80187987 | 84086632 |
| 5457 | 5 | 80187987 | 84089603 |
| 5458 | 5 | 80187987 | 84104814 |
| 5459 | 5 | 80187987 | 84105175 |
| 5460 | 5 | 80187987 | 84251635 |
| 5461 | 5 | 80187987 | 84252180 |
| 5462 | 5 | 80187987 | 84253030 |
| 5463 | 5 | 80187987 | 84254208 |
| 5464 | 5 | 80187987 | 84314930 |
| 5465 | 5 | 80187987 | 84340523 |
| 5466 | 5 | 80187987 | 84516340 |
| 5467 | 5 | 80187987 | 84706916 |
| 5468 | 5 | 80187987 | 84799488 |
| 5469 | 5 | 80187987 | 84801081 |
| 5470 | 5 | 80187987 | 84824103 |
| 5471 | 5 | 80187987 | 84824203 |
| 5472 | 5 | 80187987 | 84824816 |
| 5473 | 5 | 80187987 | 84825422 |
| 5474 | 5 | 80187987 | 84825763 |
| 5475 | 5 | 80187987 | 84825942 |
| 5476 | 5 | 80187987 | 84843411 |
| 5477 | 5 | 80187987 | 84936441 |
| 5478 | 5 | 80187987 | 84936493 |
| 5479 | 5 | 80187987 | 84943705 |
| 5480 | 5 | 80187987 | 169454950 |
| 5481 | 5 | 80187987 | 181522829 |
| 5482 | 5 | 80187987 | 204759879 |
| 5483 | 5 | 80187987 | 209874191 |
| 5484 | 5 | 80188978 | 80190673 |
| 5485 | 5 | 80188978 | 80190777 |
| 5486 | 5 | 80188978 | 80192546 |
| 5487 | 5 | 80188978 | 80195395 |
| 5488 | 5 | 80188978 | 80199923 |
| 5489 | 5 | 80188978 | 80241911 |
| 5490 | 5 | 80188978 | 80282785 |
| 5491 | 5 | 80188978 | 80345337 |
| 5492 | 5 | 80188978 | 80389787 |
| 5493 | 5 | 80188978 | 80411639 |
| 5494 | 5 | 80188978 | 80446855 |
| 5495 | 5 | 80188978 | 80492790 |
| 5496 | 5 | 80188978 | 80670554 |
| 5497 | 5 | 80188978 | 80674679 |
| 5498 | 5 | 80188978 | 80720509 |
| 5499 | 5 | 80188978 | 80800856 |
| 5500 | 5 | 80188978 | 80804587 |
| 5501 | 5 | 80188978 | 80807409 |
| 5502 | 5 | 80188978 | 80835734 |
| 5503 | 5 | 80188978 | 80971764 |
| 5504 | 5 | 80188978 | 80972258 |
| 5505 | 5 | 80188978 | 80974450 |
| 5506 | 5 | 80188978 | 81047638 |
| 5507 | 5 | 80188978 | 81082921 |
| 5508 | 5 | 80188978 | 81157909 |
| 5509 | 5 | 80188978 | 81265937 |
| 5510 | 5 | 80188978 | 81265937 |
| 5511 | 5 | 80188978 | 81267485 |
| 5512 | 5 | 80188978 | 81267499 |
| 5513 | 5 | 80188978 | 81274512 |
| 5514 | 5 | 80188978 | 81763618 |
| 5515 | 5 | 80188978 | 81797217 |
| 5516 | 5 | 80188978 | 81800186 |
| 5517 | 5 | 80188978 | 81806213 |
| 5518 | 5 | 80188978 | 81854583 |
| 5519 | 5 | 80188978 | 81859374 |
| 5520 | 5 | 80188978 | 81861368 |
| 5521 | 5 | 80188978 | 81863686 |
| 5522 | 5 | 80188978 | 81916850 |
| 5523 | 5 | 80188978 | 81954891 |
| 5524 | 5 | 80188978 | 81985250 |
| 5525 | 5 | 80188978 | 82083752 |
| 5526 | 5 | 80188978 | 82101253 |

TABLE 1-continued

Examples of chromosomal segments associated with increased fertility in maize.

| Chromosomal Segment | Chr. | Boundary 1 | Boundary 2 |
|---|---|---|---|
| 5527 | 5 | 80188978 | 82143124 |
| 5528 | 5 | 80188978 | 82236318 |
| 5529 | 5 | 80188978 | 82325587 |
| 5530 | 5 | 80188978 | 82427210 |
| 5531 | 5 | 80188978 | 82431853 |
| 5532 | 5 | 80188978 | 82446714 |
| 5533 | 5 | 80188978 | 82446794 |
| 5534 | 5 | 80188978 | 82551111 |
| 5535 | 5 | 80188978 | 82552090 |
| 5536 | 5 | 80188978 | 82555641 |
| 5537 | 5 | 80188978 | 82555670 |
| 5538 | 5 | 80188978 | 82556511 |
| 5539 | 5 | 80188978 | 82559047 |
| 5540 | 5 | 80188978 | 82561535 |
| 5541 | 5 | 80188978 | 82610100 |
| 5542 | 5 | 80188978 | 82676822 |
| 5543 | 5 | 80188978 | 82676901 |
| 5544 | 5 | 80188978 | 82883691 |
| 5545 | 5 | 80188978 | 82954942 |
| 5546 | 5 | 80188978 | 82971688 |
| 5547 | 5 | 80188978 | 83023965 |
| 5548 | 5 | 80188978 | 83094205 |
| 5549 | 5 | 80188978 | 83146355 |
| 5550 | 5 | 80188978 | 83280630 |
| 5551 | 5 | 80188978 | 83281412 |
| 5552 | 5 | 80188978 | 83400242 |
| 5553 | 5 | 80188978 | 83405797 |
| 5554 | 5 | 80188978 | 83437132 |
| 5555 | 5 | 80188978 | 83522252 |
| 5556 | 5 | 80188978 | 83560095 |
| 5557 | 5 | 80188978 | 83560204 |
| 5558 | 5 | 80188978 | 83572400 |
| 5559 | 5 | 80188978 | 83607661 |
| 5560 | 5 | 80188978 | 83745342 |
| 5561 | 5 | 80188978 | 83861275 |
| 5562 | 5 | 80188978 | 83861633 |
| 5563 | 5 | 80188978 | 83865653 |
| 5564 | 5 | 80188978 | 83865914 |
| 5565 | 5 | 80188978 | 83865920 |
| 5566 | 5 | 80188978 | 83868010 |
| 5567 | 5 | 80188978 | 84019752 |
| 5568 | 5 | 80188978 | 84065912 |
| 5569 | 5 | 80188978 | 84086632 |
| 5570 | 5 | 80188978 | 84089603 |
| 5571 | 5 | 80188978 | 84104814 |
| 5572 | 5 | 80188978 | 84105175 |
| 5573 | 5 | 80188978 | 84251635 |
| 5574 | 5 | 80188978 | 84252180 |
| 5575 | 5 | 80188978 | 84253030 |
| 5576 | 5 | 80188978 | 84254208 |
| 5577 | 5 | 80188978 | 84314930 |
| 5578 | 5 | 80188978 | 84340523 |
| 5579 | 5 | 80188978 | 84516340 |
| 5580 | 5 | 80188978 | 84706916 |
| 5581 | 5 | 80188978 | 84799488 |
| 5582 | 5 | 80188978 | 84801081 |
| 5583 | 5 | 80188978 | 84824103 |
| 5584 | 5 | 80188978 | 84824203 |
| 5585 | 5 | 80188978 | 84824816 |
| 5586 | 5 | 80188978 | 84825422 |
| 5587 | 5 | 80188978 | 84825763 |
| 5588 | 5 | 80188978 | 84825942 |
| 5589 | 5 | 80188978 | 84843411 |
| 5590 | 5 | 80188978 | 84936441 |
| 5591 | 5 | 80188978 | 84936493 |
| 5592 | 5 | 80188978 | 84943705 |
| 5593 | 5 | 80188978 | 169454950 |
| 5594 | 5 | 80188978 | 181522829 |
| 5595 | 5 | 80188978 | 204759879 |
| 5596 | 5 | 80188978 | 209874191 |
| 5597 | 5 | 80191781 | 80192546 |
| 5598 | 5 | 80191781 | 80195395 |
| 5599 | 5 | 80191781 | 80199923 |
| 5600 | 5 | 80191781 | 80241911 |
| 5601 | 5 | 80191781 | 80282785 |
| 5602 | 5 | 80191781 | 80345337 |
| 5603 | 5 | 80191781 | 80389787 |
| 5604 | 5 | 80191781 | 80411639 |
| 5605 | 5 | 80191781 | 80446855 |
| 5606 | 5 | 80191781 | 80492790 |
| 5607 | 5 | 80191781 | 80670554 |
| 5608 | 5 | 80191781 | 80674679 |
| 5609 | 5 | 80191781 | 80720509 |
| 5610 | 5 | 80191781 | 80800856 |
| 5611 | 5 | 80191781 | 80804587 |
| 5612 | 5 | 80191781 | 80807409 |
| 5613 | 5 | 80191781 | 80835734 |
| 5614 | 5 | 80191781 | 80971764 |
| 5615 | 5 | 80191781 | 80972258 |
| 5616 | 5 | 80191781 | 80974450 |
| 5617 | 5 | 80191781 | 81047638 |
| 5618 | 5 | 80191781 | 81082921 |
| 5619 | 5 | 80191781 | 81157909 |
| 5620 | 5 | 80191781 | 81265937 |
| 5621 | 5 | 80191781 | 81265937 |
| 5622 | 5 | 80191781 | 81267485 |
| 5623 | 5 | 80191781 | 81267499 |
| 5624 | 5 | 80191781 | 81274512 |
| 5625 | 5 | 80191781 | 81763618 |
| 5626 | 5 | 80191781 | 81797217 |
| 5627 | 5 | 80191781 | 81800186 |
| 5628 | 5 | 80191781 | 81806213 |
| 5629 | 5 | 80191781 | 81854583 |
| 5630 | 5 | 80191781 | 81859374 |
| 5631 | 5 | 80191781 | 81861368 |
| 5632 | 5 | 80191781 | 81863686 |
| 5633 | 5 | 80191781 | 81916850 |
| 5634 | 5 | 80191781 | 81954891 |
| 5635 | 5 | 80191781 | 81985250 |
| 5636 | 5 | 80191781 | 82083752 |
| 5637 | 5 | 80191781 | 82101253 |
| 5638 | 5 | 80191781 | 82143124 |
| 5639 | 5 | 80191781 | 82236318 |
| 5640 | 5 | 80191781 | 82325587 |
| 5641 | 5 | 80191781 | 82427210 |
| 5642 | 5 | 80191781 | 82431853 |
| 5643 | 5 | 80191781 | 82446714 |
| 5644 | 5 | 80191781 | 82446794 |
| 5645 | 5 | 80191781 | 82551111 |
| 5646 | 5 | 80191781 | 82552090 |
| 5647 | 5 | 80191781 | 82555641 |
| 5648 | 5 | 80191781 | 82555670 |
| 5649 | 5 | 80191781 | 82556511 |
| 5650 | 5 | 80191781 | 82559047 |
| 5651 | 5 | 80191781 | 82561535 |
| 5652 | 5 | 80191781 | 82610100 |
| 5653 | 5 | 80191781 | 82676822 |
| 5654 | 5 | 80191781 | 82676901 |
| 5655 | 5 | 80191781 | 82883691 |
| 5656 | 5 | 80191781 | 82954942 |
| 5657 | 5 | 80191781 | 82971688 |
| 5658 | 5 | 80191781 | 83023965 |
| 5659 | 5 | 80191781 | 83094205 |
| 5660 | 5 | 80191781 | 83146355 |
| 5661 | 5 | 80191781 | 83280630 |
| 5662 | 5 | 80191781 | 83281412 |
| 5663 | 5 | 80191781 | 83400242 |
| 5664 | 5 | 80191781 | 83405797 |
| 5665 | 5 | 80191781 | 83437132 |
| 5666 | 5 | 80191781 | 83522252 |
| 5667 | 5 | 80191781 | 83560095 |
| 5668 | 5 | 80191781 | 83560204 |
| 5669 | 5 | 80191781 | 83572400 |
| 5670 | 5 | 80191781 | 83607661 |
| 5671 | 5 | 80191781 | 83745342 |
| 5672 | 5 | 80191781 | 83861275 |
| 5673 | 5 | 80191781 | 83861633 |
| 5674 | 5 | 80191781 | 83865653 |

TABLE 1-continued

Examples of chromosomal segments associated with increased fertility in maize.

| Chromosomal Segment | Chr. | Boundary 1 | Boundary 2 |
|---|---|---|---|
| 5675 | 5 | 80191781 | 83865914 |
| 5676 | 5 | 80191781 | 83865920 |
| 5677 | 5 | 80191781 | 83868010 |
| 5678 | 5 | 80191781 | 84019752 |
| 5679 | 5 | 80191781 | 84065912 |
| 5680 | 5 | 80191781 | 84086632 |
| 5681 | 5 | 80191781 | 84089603 |
| 5682 | 5 | 80191781 | 84104814 |
| 5683 | 5 | 80191781 | 84105175 |
| 5684 | 5 | 80191781 | 84251635 |
| 5685 | 5 | 80191781 | 84252180 |
| 5686 | 5 | 80191781 | 84253030 |
| 5687 | 5 | 80191781 | 84254208 |
| 5688 | 5 | 80191781 | 84314930 |
| 5689 | 5 | 80191781 | 84340523 |
| 5690 | 5 | 80191781 | 84516340 |
| 5691 | 5 | 80191781 | 84706916 |
| 5692 | 5 | 80191781 | 84799488 |
| 5693 | 5 | 80191781 | 84801081 |
| 5694 | 5 | 80191781 | 84824103 |
| 5695 | 5 | 80191781 | 84824203 |
| 5696 | 5 | 80191781 | 84824816 |
| 5697 | 5 | 80191781 | 84825422 |
| 5698 | 5 | 80191781 | 84825763 |
| 5699 | 5 | 80191781 | 84825942 |
| 5700 | 5 | 80191781 | 84843411 |
| 5701 | 5 | 80191781 | 84936441 |
| 5702 | 5 | 80191781 | 84936493 |
| 5703 | 5 | 80191781 | 84943705 |
| 5704 | 5 | 80191781 | 169454950 |
| 5705 | 5 | 80191781 | 181522829 |
| 5706 | 5 | 80191781 | 204759879 |
| 5707 | 5 | 80191781 | 209874191 |
| 5708 | 5 | 80195077 | 80195395 |
| 5709 | 5 | 80195077 | 80199923 |
| 5710 | 5 | 80195077 | 80241911 |
| 5711 | 5 | 80195077 | 80282785 |
| 5712 | 5 | 80195077 | 80345337 |
| 5713 | 5 | 80195077 | 80389787 |
| 5714 | 5 | 80195077 | 80411639 |
| 5715 | 5 | 80195077 | 80446855 |
| 5716 | 5 | 80195077 | 80492790 |
| 5717 | 5 | 80195077 | 80670554 |
| 5718 | 5 | 80195077 | 80674679 |
| 5719 | 5 | 80195077 | 80720509 |
| 5720 | 5 | 80195077 | 80800856 |
| 5721 | 5 | 80195077 | 80804587 |
| 5722 | 5 | 80195077 | 80807409 |
| 5723 | 5 | 80195077 | 80835734 |
| 5724 | 5 | 80195077 | 80971764 |
| 5725 | 5 | 80195077 | 80972258 |
| 5726 | 5 | 80195077 | 80974450 |
| 5727 | 5 | 80195077 | 81047638 |
| 5728 | 5 | 80195077 | 81082921 |
| 5729 | 5 | 80195077 | 81157909 |
| 5730 | 5 | 80195077 | 81265937 |
| 5731 | 5 | 80195077 | 81265937 |
| 5732 | 5 | 80195077 | 81267485 |
| 5733 | 5 | 80195077 | 81267499 |
| 5734 | 5 | 80195077 | 81274512 |
| 5735 | 5 | 80195077 | 81763618 |
| 5736 | 5 | 80195077 | 81797217 |
| 5737 | 5 | 80195077 | 81800186 |
| 5738 | 5 | 80195077 | 81806213 |
| 5739 | 5 | 80195077 | 81854583 |
| 5740 | 5 | 80195077 | 81859374 |
| 5741 | 5 | 80195077 | 81861368 |
| 5742 | 5 | 80195077 | 81863686 |
| 5743 | 5 | 80195077 | 81916850 |
| 5744 | 5 | 80195077 | 81954891 |
| 5745 | 5 | 80195077 | 81985250 |
| 5746 | 5 | 80195077 | 82083752 |
| 5747 | 5 | 80195077 | 82101253 |
| 5748 | 5 | 80195077 | 82143124 |
| 5749 | 5 | 80195077 | 82236318 |
| 5750 | 5 | 80195077 | 82325587 |
| 5751 | 5 | 80195077 | 82427210 |
| 5752 | 5 | 80195077 | 82431853 |
| 5753 | 5 | 80195077 | 82446714 |
| 5754 | 5 | 80195077 | 82446794 |
| 5755 | 5 | 80195077 | 82551111 |
| 5756 | 5 | 80195077 | 82552090 |
| 5757 | 5 | 80195077 | 82555641 |
| 5758 | 5 | 80195077 | 82555670 |
| 5759 | 5 | 80195077 | 82556511 |
| 5760 | 5 | 80195077 | 82559047 |
| 5761 | 5 | 80195077 | 82561535 |
| 5762 | 5 | 80195077 | 82610100 |
| 5763 | 5 | 80195077 | 82676822 |
| 5764 | 5 | 80195077 | 82676901 |
| 5765 | 5 | 80195077 | 82883691 |
| 5766 | 5 | 80195077 | 82954942 |
| 5767 | 5 | 80195077 | 82971688 |
| 5768 | 5 | 80195077 | 83023965 |
| 5769 | 5 | 80195077 | 83094205 |
| 5770 | 5 | 80195077 | 83146355 |
| 5771 | 5 | 80195077 | 83280630 |
| 5772 | 5 | 80195077 | 83281412 |
| 5773 | 5 | 80195077 | 83400242 |
| 5774 | 5 | 80195077 | 83405797 |
| 5775 | 5 | 80195077 | 83437132 |
| 5776 | 5 | 80195077 | 83522252 |
| 5777 | 5 | 80195077 | 83560095 |
| 5778 | 5 | 80195077 | 83560204 |
| 5779 | 5 | 80195077 | 83572400 |
| 5780 | 5 | 80195077 | 83607661 |
| 5781 | 5 | 80195077 | 83745342 |
| 5782 | 5 | 80195077 | 83861275 |
| 5783 | 5 | 80195077 | 83861633 |
| 5784 | 5 | 80195077 | 83865653 |
| 5785 | 5 | 80195077 | 83865914 |
| 5786 | 5 | 80195077 | 83865920 |
| 5787 | 5 | 80195077 | 83868010 |
| 5788 | 5 | 80195077 | 84019752 |
| 5789 | 5 | 80195077 | 84065912 |
| 5790 | 5 | 80195077 | 84086632 |
| 5791 | 5 | 80195077 | 84089603 |
| 5792 | 5 | 80195077 | 84104814 |
| 5793 | 5 | 80195077 | 84105175 |
| 5794 | 5 | 80195077 | 84251635 |
| 5795 | 5 | 80195077 | 84252180 |
| 5796 | 5 | 80195077 | 84253030 |
| 5797 | 5 | 80195077 | 84254208 |
| 5798 | 5 | 80195077 | 84314930 |
| 5799 | 5 | 80195077 | 84340523 |
| 5800 | 5 | 80195077 | 84516340 |
| 5801 | 5 | 80195077 | 84706916 |
| 5802 | 5 | 80195077 | 84799488 |
| 5803 | 5 | 80195077 | 84801081 |
| 5804 | 5 | 80195077 | 84824103 |
| 5805 | 5 | 80195077 | 84824203 |
| 5806 | 5 | 80195077 | 84824816 |
| 5807 | 5 | 80195077 | 84825422 |
| 5808 | 5 | 80195077 | 84825763 |
| 5809 | 5 | 80195077 | 84825942 |
| 5810 | 5 | 80195077 | 84843411 |
| 5811 | 5 | 80195077 | 84936441 |
| 5812 | 5 | 80195077 | 84936493 |
| 5813 | 5 | 80195077 | 84943705 |
| 5814 | 5 | 80195077 | 169454950 |
| 5815 | 5 | 80195077 | 181522829 |
| 5816 | 5 | 80195077 | 204759879 |
| 5817 | 5 | 80195077 | 209874191 |
| 5818 | 5 | 80195395 | 80199923 |
| 5819 | 5 | 80195395 | 80241911 |
| 5820 | 5 | 80195395 | 80282785 |
| 5821 | 5 | 80195395 | 80345337 |
| 5822 | 5 | 80195395 | 80389787 |

TABLE 1-continued

Examples of chromosomal segments associated with increased fertility in maize.

| Chromosomal Segment | Chr. | Boundary 1 | Boundary 2 |
|---|---|---|---|
| 5823 | 5 | 80195395 | 80411639 |
| 5824 | 5 | 80195395 | 80446855 |
| 5825 | 5 | 80195395 | 80492790 |
| 5826 | 5 | 80195395 | 80670554 |
| 5827 | 5 | 80195395 | 80674679 |
| 5828 | 5 | 80195395 | 80720509 |
| 5829 | 5 | 80195395 | 80800856 |
| 5830 | 5 | 80195395 | 80804587 |
| 5831 | 5 | 80195395 | 80807409 |
| 5832 | 5 | 80195395 | 80835734 |
| 5833 | 5 | 80195395 | 80971764 |
| 5834 | 5 | 80195395 | 80972258 |
| 5835 | 5 | 80195395 | 80974450 |
| 5836 | 5 | 80195395 | 81047638 |
| 5837 | 5 | 80195395 | 81082921 |
| 5838 | 5 | 80195395 | 81157909 |
| 5839 | 5 | 80195395 | 81265937 |
| 5840 | 5 | 80195395 | 81265937 |
| 5841 | 5 | 80195395 | 81267485 |
| 5842 | 5 | 80195395 | 81267499 |
| 5843 | 5 | 80195395 | 81274512 |
| 5844 | 5 | 80195395 | 81763618 |
| 5845 | 5 | 80195395 | 81797217 |
| 5846 | 5 | 80195395 | 81800186 |
| 5847 | 5 | 80195395 | 81806213 |
| 5848 | 5 | 80195395 | 81854583 |
| 5849 | 5 | 80195395 | 81859374 |
| 5850 | 5 | 80195395 | 81861368 |
| 5851 | 5 | 80195395 | 81863686 |
| 5852 | 5 | 80195395 | 81916850 |
| 5853 | 5 | 80195395 | 81954891 |
| 5854 | 5 | 80195395 | 81985250 |
| 5855 | 5 | 80195395 | 82083752 |
| 5856 | 5 | 80195395 | 82101253 |
| 5857 | 5 | 80195395 | 82143124 |
| 5858 | 5 | 80195395 | 82236318 |
| 5859 | 5 | 80195395 | 82325587 |
| 5860 | 5 | 80195395 | 82427210 |
| 5861 | 5 | 80195395 | 82431853 |
| 5862 | 5 | 80195395 | 82446714 |
| 5863 | 5 | 80195395 | 82446794 |
| 5864 | 5 | 80195395 | 82551111 |
| 5865 | 5 | 80195395 | 82552090 |
| 5866 | 5 | 80195395 | 82555641 |
| 5867 | 5 | 80195395 | 82555670 |
| 5868 | 5 | 80195395 | 82556511 |
| 5869 | 5 | 80195395 | 82559047 |
| 5870 | 5 | 80195395 | 82561535 |
| 5871 | 5 | 80195395 | 82610100 |
| 5872 | 5 | 80195395 | 82676822 |
| 5873 | 5 | 80195395 | 82676901 |
| 5874 | 5 | 80195395 | 82883691 |
| 5875 | 5 | 80195395 | 82954942 |
| 5876 | 5 | 80195395 | 82971688 |
| 5877 | 5 | 80195395 | 83023965 |
| 5878 | 5 | 80195395 | 83094205 |
| 5879 | 5 | 80195395 | 83146355 |
| 5880 | 5 | 80195395 | 83280630 |
| 5881 | 5 | 80195395 | 83281412 |
| 5882 | 5 | 80195395 | 83400242 |
| 5883 | 5 | 80195395 | 83405797 |
| 5884 | 5 | 80195395 | 83437132 |
| 5885 | 5 | 80195395 | 83522252 |
| 5886 | 5 | 80195395 | 83560095 |
| 5887 | 5 | 80195395 | 83560204 |
| 5888 | 5 | 80195395 | 83572400 |
| 5889 | 5 | 80195395 | 83607661 |
| 5890 | 5 | 80195395 | 83745342 |
| 5891 | 5 | 80195395 | 83861275 |
| 5892 | 5 | 80195395 | 83861633 |
| 5893 | 5 | 80195395 | 83865653 |
| 5894 | 5 | 80195395 | 83865914 |
| 5895 | 5 | 80195395 | 83865920 |
| 5896 | 5 | 80195395 | 83868010 |
| 5897 | 5 | 80195395 | 84019752 |
| 5898 | 5 | 80195395 | 84065912 |
| 5899 | 5 | 80195395 | 84086632 |
| 5900 | 5 | 80195395 | 84089603 |
| 5901 | 5 | 80195395 | 84104814 |
| 5902 | 5 | 80195395 | 84105175 |
| 5903 | 5 | 80195395 | 84251635 |
| 5904 | 5 | 80195395 | 84252180 |
| 5905 | 5 | 80195395 | 84253030 |
| 5906 | 5 | 80195395 | 84254208 |
| 5907 | 5 | 80195395 | 84314930 |
| 5908 | 5 | 80195395 | 84340523 |
| 5909 | 5 | 80195395 | 84516340 |
| 5910 | 5 | 80195395 | 84706916 |
| 5911 | 5 | 80195395 | 84799488 |
| 5912 | 5 | 80195395 | 84801081 |
| 5913 | 5 | 80195395 | 84824103 |
| 5914 | 5 | 80195395 | 84824203 |
| 5915 | 5 | 80195395 | 84824816 |
| 5916 | 5 | 80195395 | 84825422 |
| 5917 | 5 | 80195395 | 84825763 |
| 5918 | 5 | 80195395 | 84825942 |
| 5919 | 5 | 80195395 | 84843411 |
| 5920 | 5 | 80195395 | 84936441 |
| 5921 | 5 | 80195395 | 84936493 |
| 5922 | 5 | 80195395 | 84943705 |
| 5923 | 5 | 80195395 | 169454950 |
| 5924 | 5 | 80195395 | 181522829 |
| 5925 | 5 | 80195395 | 204759879 |
| 5926 | 5 | 80195395 | 209874191 |
| 5927 | 5 | 80195714 | 80199923 |
| 5928 | 5 | 80195714 | 80241911 |
| 5929 | 5 | 80195714 | 80282785 |
| 5930 | 5 | 80195714 | 80345337 |
| 5931 | 5 | 80195714 | 80389787 |
| 5932 | 5 | 80195714 | 80411639 |
| 5933 | 5 | 80195714 | 80446855 |
| 5934 | 5 | 80195714 | 80492790 |
| 5935 | 5 | 80195714 | 80670554 |
| 5936 | 5 | 80195714 | 80674679 |
| 5937 | 5 | 80195714 | 80720509 |
| 5938 | 5 | 80195714 | 80800856 |
| 5939 | 5 | 80195714 | 80804587 |
| 5940 | 5 | 80195714 | 80807409 |
| 5941 | 5 | 80195714 | 80835734 |
| 5942 | 5 | 80195714 | 80971764 |
| 5943 | 5 | 80195714 | 80972258 |
| 5944 | 5 | 80195714 | 80974450 |
| 5945 | 5 | 80195714 | 81047638 |
| 5946 | 5 | 80195714 | 81082921 |
| 5947 | 5 | 80195714 | 81157909 |
| 5948 | 5 | 80195714 | 81265937 |
| 5949 | 5 | 80195714 | 81265937 |
| 5950 | 5 | 80195714 | 81267485 |
| 5951 | 5 | 80195714 | 81267499 |
| 5952 | 5 | 80195714 | 81274512 |
| 5953 | 5 | 80195714 | 81763618 |
| 5954 | 5 | 80195714 | 81797217 |
| 5955 | 5 | 80195714 | 81800186 |
| 5956 | 5 | 80195714 | 81806213 |
| 5957 | 5 | 80195714 | 81854583 |
| 5958 | 5 | 80195714 | 81859374 |
| 5959 | 5 | 80195714 | 81861368 |
| 5960 | 5 | 80195714 | 81863686 |
| 5961 | 5 | 80195714 | 81916850 |
| 5962 | 5 | 80195714 | 81954891 |
| 5963 | 5 | 80195714 | 81985250 |
| 5964 | 5 | 80195714 | 82083752 |
| 5965 | 5 | 80195714 | 82101253 |
| 5966 | 5 | 80195714 | 82143124 |
| 5967 | 5 | 80195714 | 82236318 |
| 5968 | 5 | 80195714 | 82325587 |
| 5969 | 5 | 80195714 | 82427210 |
| 5970 | 5 | 80195714 | 82431853 |

TABLE 1-continued

Examples of chromosomal segments associated with increased fertility in maize.

| Chromosomal Segment | Chr. | Boundary 1 | Boundary 2 |
|---|---|---|---|
| 5971 | 5 | 80195714 | 82446714 |
| 5972 | 5 | 80195714 | 82446794 |
| 5973 | 5 | 80195714 | 82551111 |
| 5974 | 5 | 80195714 | 82552090 |
| 5975 | 5 | 80195714 | 82555641 |
| 5976 | 5 | 80195714 | 82555670 |
| 5977 | 5 | 80195714 | 82556511 |
| 5978 | 5 | 80195714 | 82559047 |
| 5979 | 5 | 80195714 | 82561535 |
| 5980 | 5 | 80195714 | 82610100 |
| 5981 | 5 | 80195714 | 82676822 |
| 5982 | 5 | 80195714 | 82676901 |
| 5983 | 5 | 80195714 | 82883691 |
| 5984 | 5 | 80195714 | 82954942 |
| 5985 | 5 | 80195714 | 82971688 |
| 5986 | 5 | 80195714 | 83023965 |
| 5987 | 5 | 80195714 | 83094205 |
| 5988 | 5 | 80195714 | 83146355 |
| 5989 | 5 | 80195714 | 83280630 |
| 5990 | 5 | 80195714 | 83281412 |
| 5991 | 5 | 80195714 | 83400242 |
| 5992 | 5 | 80195714 | 83405797 |
| 5993 | 5 | 80195714 | 83437132 |
| 5994 | 5 | 80195714 | 83522252 |
| 5995 | 5 | 80195714 | 83560095 |
| 5996 | 5 | 80195714 | 83560204 |
| 5997 | 5 | 80195714 | 83572400 |
| 5998 | 5 | 80195714 | 83607661 |
| 5999 | 5 | 80195714 | 83745342 |
| 6000 | 5 | 80195714 | 83861275 |
| 6001 | 5 | 80195714 | 83861633 |
| 6002 | 5 | 80195714 | 83865653 |
| 6003 | 5 | 80195714 | 83865914 |
| 6004 | 5 | 80195714 | 83865920 |
| 6005 | 5 | 80195714 | 83868010 |
| 6006 | 5 | 80195714 | 84019752 |
| 6007 | 5 | 80195714 | 84065912 |
| 6008 | 5 | 80195714 | 84086632 |
| 6009 | 5 | 80195714 | 84089603 |
| 6010 | 5 | 80195714 | 84104814 |
| 6011 | 5 | 80195714 | 84105175 |
| 6012 | 5 | 80195714 | 84251635 |
| 6013 | 5 | 80195714 | 84252180 |
| 6014 | 5 | 80195714 | 84253030 |
| 6015 | 5 | 80195714 | 84254208 |
| 6016 | 5 | 80195714 | 84314930 |
| 6017 | 5 | 80195714 | 84340523 |
| 6018 | 5 | 80195714 | 84516340 |
| 6019 | 5 | 80195714 | 84706916 |
| 6020 | 5 | 80195714 | 84799488 |
| 6021 | 5 | 80195714 | 84801081 |
| 6022 | 5 | 80195714 | 84824103 |
| 6023 | 5 | 80195714 | 84824203 |
| 6024 | 5 | 80195714 | 84824816 |
| 6025 | 5 | 80195714 | 84825422 |
| 6026 | 5 | 80195714 | 84825763 |
| 6027 | 5 | 80195714 | 84825942 |
| 6028 | 5 | 80195714 | 84843411 |
| 6029 | 5 | 80195714 | 84936441 |
| 6030 | 5 | 80195714 | 84936493 |
| 6031 | 5 | 80195714 | 84943705 |
| 6032 | 5 | 80195714 | 169454950 |
| 6033 | 5 | 80195714 | 181522829 |
| 6034 | 5 | 80195714 | 204759879 |
| 6035 | 5 | 80195714 | 209874191 |
| 6036 | 5 | 80236478 | 80241911 |
| 6037 | 5 | 80236478 | 80282785 |
| 6038 | 5 | 80236478 | 80345337 |
| 6039 | 5 | 80236478 | 80389787 |
| 6040 | 5 | 80236478 | 80411639 |
| 6041 | 5 | 80236478 | 80446855 |
| 6042 | 5 | 80236478 | 80492790 |
| 6043 | 5 | 80236478 | 80670554 |
| 6044 | 5 | 80236478 | 80674679 |
| 6045 | 5 | 80236478 | 80720509 |
| 6046 | 5 | 80236478 | 80800856 |
| 6047 | 5 | 80236478 | 80804587 |
| 6048 | 5 | 80236478 | 80807409 |
| 6049 | 5 | 80236478 | 80835734 |
| 6050 | 5 | 80236478 | 80971764 |
| 6051 | 5 | 80236478 | 80972258 |
| 6052 | 5 | 80236478 | 80974450 |
| 6053 | 5 | 80236478 | 81047638 |
| 6054 | 5 | 80236478 | 81082921 |
| 6055 | 5 | 80236478 | 81157909 |
| 6056 | 5 | 80236478 | 81265937 |
| 6057 | 5 | 80236478 | 81265937 |
| 6058 | 5 | 80236478 | 81267485 |
| 6059 | 5 | 80236478 | 81267499 |
| 6060 | 5 | 80236478 | 81274512 |
| 6061 | 5 | 80236478 | 81763618 |
| 6062 | 5 | 80236478 | 81797217 |
| 6063 | 5 | 80236478 | 81800186 |
| 6064 | 5 | 80236478 | 81806213 |
| 6065 | 5 | 80236478 | 81854583 |
| 6066 | 5 | 80236478 | 81859374 |
| 6067 | 5 | 80236478 | 81861368 |
| 6068 | 5 | 80236478 | 81863686 |
| 6069 | 5 | 80236478 | 81916850 |
| 6070 | 5 | 80236478 | 81954891 |
| 6071 | 5 | 80236478 | 81985250 |
| 6072 | 5 | 80236478 | 82083752 |
| 6073 | 5 | 80236478 | 82101253 |
| 6074 | 5 | 80236478 | 82143124 |
| 6075 | 5 | 80236478 | 82236318 |
| 6076 | 5 | 80236478 | 82325587 |
| 6077 | 5 | 80236478 | 82427210 |
| 6078 | 5 | 80236478 | 82431853 |
| 6079 | 5 | 80236478 | 82446714 |
| 6080 | 5 | 80236478 | 82446794 |
| 6081 | 5 | 80236478 | 82551111 |
| 6082 | 5 | 80236478 | 82552090 |
| 6083 | 5 | 80236478 | 82555641 |
| 6084 | 5 | 80236478 | 82555670 |
| 6085 | 5 | 80236478 | 82556511 |
| 6086 | 5 | 80236478 | 82559047 |
| 6087 | 5 | 80236478 | 82561535 |
| 6088 | 5 | 80236478 | 82610100 |
| 6089 | 5 | 80236478 | 82676822 |
| 6090 | 5 | 80236478 | 82676901 |
| 6091 | 5 | 80236478 | 82883691 |
| 6092 | 5 | 80236478 | 82954942 |
| 6093 | 5 | 80236478 | 82971688 |
| 6094 | 5 | 80236478 | 83023965 |
| 6095 | 5 | 80236478 | 83094205 |
| 6096 | 5 | 80236478 | 83146355 |
| 6097 | 5 | 80236478 | 83280630 |
| 6098 | 5 | 80236478 | 83281412 |
| 6099 | 5 | 80236478 | 83400242 |
| 6100 | 5 | 80236478 | 83405797 |
| 6101 | 5 | 80236478 | 83437132 |
| 6102 | 5 | 80236478 | 83522252 |
| 6103 | 5 | 80236478 | 83560095 |
| 6104 | 5 | 80236478 | 83560204 |
| 6105 | 5 | 80236478 | 83572400 |
| 6106 | 5 | 80236478 | 83607661 |
| 6107 | 5 | 80236478 | 83745342 |
| 6108 | 5 | 80236478 | 83861275 |
| 6109 | 5 | 80236478 | 83861633 |
| 6110 | 5 | 80236478 | 83865653 |
| 6111 | 5 | 80236478 | 83865914 |
| 6112 | 5 | 80236478 | 83865920 |
| 6113 | 5 | 80236478 | 83868010 |
| 6114 | 5 | 80236478 | 84019752 |
| 6115 | 5 | 80236478 | 84065912 |
| 6116 | 5 | 80236478 | 84086632 |
| 6117 | 5 | 80236478 | 84089603 |
| 6118 | 5 | 80236478 | 84104814 |

TABLE 1-continued

Examples of chromosomal segments associated with increased fertility in maize.

| Chromosomal Segment | Chr. | Boundary 1 | Boundary 2 |
|---|---|---|---|
| 6119 | 5 | 80236478 | 84105175 |
| 6120 | 5 | 80236478 | 84251635 |
| 6121 | 5 | 80236478 | 84252180 |
| 6122 | 5 | 80236478 | 84253030 |
| 6123 | 5 | 80236478 | 84254208 |
| 6124 | 5 | 80236478 | 84314930 |
| 6125 | 5 | 80236478 | 84340523 |
| 6126 | 5 | 80236478 | 84516340 |
| 6127 | 5 | 80236478 | 84706916 |
| 6128 | 5 | 80236478 | 84799488 |
| 6129 | 5 | 80236478 | 84801081 |
| 6130 | 5 | 80236478 | 84824103 |
| 6131 | 5 | 80236478 | 84824203 |
| 6132 | 5 | 80236478 | 84824816 |
| 6133 | 5 | 80236478 | 84825422 |
| 6134 | 5 | 80236478 | 84825763 |
| 6135 | 5 | 80236478 | 84825942 |
| 6136 | 5 | 80236478 | 84843411 |
| 6137 | 5 | 80236478 | 84936441 |
| 6138 | 5 | 80236478 | 84936493 |
| 6139 | 5 | 80236478 | 84943705 |
| 6140 | 5 | 80236478 | 169454950 |
| 6141 | 5 | 80236478 | 181522829 |
| 6142 | 5 | 80236478 | 204759879 |
| 6143 | 5 | 80236478 | 209874191 |
| 6144 | 5 | 80238986 | 80241911 |
| 6145 | 5 | 80238986 | 80282785 |
| 6146 | 5 | 80238986 | 80345337 |
| 6147 | 5 | 80238986 | 80389787 |
| 6148 | 5 | 80238986 | 80411639 |
| 6149 | 5 | 80238986 | 80446855 |
| 6150 | 5 | 80238986 | 80492790 |
| 6151 | 5 | 80238986 | 80670554 |
| 6152 | 5 | 80238986 | 80674679 |
| 6153 | 5 | 80238986 | 80720509 |
| 6154 | 5 | 80238986 | 80800856 |
| 6155 | 5 | 80238986 | 80804587 |
| 6156 | 5 | 80238986 | 80807409 |
| 6157 | 5 | 80238986 | 80835734 |
| 6158 | 5 | 80238986 | 80971764 |
| 6159 | 5 | 80238986 | 80972258 |
| 6160 | 5 | 80238986 | 80974450 |
| 6161 | 5 | 80238986 | 81047638 |
| 6162 | 5 | 80238986 | 81082921 |
| 6163 | 5 | 80238986 | 81157909 |
| 6164 | 5 | 80238986 | 81265937 |
| 6165 | 5 | 80238986 | 81265937 |
| 6166 | 5 | 80238986 | 81267485 |
| 6167 | 5 | 80238986 | 81267499 |
| 6168 | 5 | 80238986 | 81274512 |
| 6169 | 5 | 80238986 | 81763618 |
| 6170 | 5 | 80238986 | 81797217 |
| 6171 | 5 | 80238986 | 81800186 |
| 6172 | 5 | 80238986 | 81806213 |
| 6173 | 5 | 80238986 | 81854583 |
| 6174 | 5 | 80238986 | 81859374 |
| 6175 | 5 | 80238986 | 81861368 |
| 6176 | 5 | 80238986 | 81863686 |
| 6177 | 5 | 80238986 | 81916850 |
| 6178 | 5 | 80238986 | 81954891 |
| 6179 | 5 | 80238986 | 81985250 |
| 6180 | 5 | 80238986 | 82083752 |
| 6181 | 5 | 80238986 | 82101253 |
| 6182 | 5 | 80238986 | 82143124 |
| 6183 | 5 | 80238986 | 82236318 |
| 6184 | 5 | 80238986 | 82325587 |
| 6185 | 5 | 80238986 | 82427210 |
| 6186 | 5 | 80238986 | 82431853 |
| 6187 | 5 | 80238986 | 82446714 |
| 6188 | 5 | 80238986 | 82446794 |
| 6189 | 5 | 80238986 | 82551111 |
| 6190 | 5 | 80238986 | 82552090 |
| 6191 | 5 | 80238986 | 82555641 |
| 6192 | 5 | 80238986 | 82555670 |
| 6193 | 5 | 80238986 | 82556511 |
| 6194 | 5 | 80238986 | 82559047 |
| 6195 | 5 | 80238986 | 82561535 |
| 6196 | 5 | 80238986 | 82610100 |
| 6197 | 5 | 80238986 | 82676822 |
| 6198 | 5 | 80238986 | 82676901 |
| 6199 | 5 | 80238986 | 82883691 |
| 6200 | 5 | 80238986 | 82954942 |
| 6201 | 5 | 80238986 | 82971688 |
| 6202 | 5 | 80238986 | 83023965 |
| 6203 | 5 | 80238986 | 83094205 |
| 6204 | 5 | 80238986 | 83146355 |
| 6205 | 5 | 80238986 | 83280630 |
| 6206 | 5 | 80238986 | 83281412 |
| 6207 | 5 | 80238986 | 83400242 |
| 6208 | 5 | 80238986 | 83405797 |
| 6209 | 5 | 80238986 | 83437132 |
| 6210 | 5 | 80238986 | 83522252 |
| 6211 | 5 | 80238986 | 83560095 |
| 6212 | 5 | 80238986 | 83560204 |
| 6213 | 5 | 80238986 | 83572400 |
| 6214 | 5 | 80238986 | 83607661 |
| 6215 | 5 | 80238986 | 83745342 |
| 6216 | 5 | 80238986 | 83861275 |
| 6217 | 5 | 80238986 | 83861633 |
| 6218 | 5 | 80238986 | 83865653 |
| 6219 | 5 | 80238986 | 83865914 |
| 6220 | 5 | 80238986 | 83865920 |
| 6221 | 5 | 80238986 | 83868010 |
| 6222 | 5 | 80238986 | 84019752 |
| 6223 | 5 | 80238986 | 84065912 |
| 6224 | 5 | 80238986 | 84086632 |
| 6225 | 5 | 80238986 | 84089603 |
| 6226 | 5 | 80238986 | 84104814 |
| 6227 | 5 | 80238986 | 84105175 |
| 6228 | 5 | 80238986 | 84251635 |
| 6229 | 5 | 80238986 | 84252180 |
| 6230 | 5 | 80238986 | 84253030 |
| 6231 | 5 | 80238986 | 84254208 |
| 6232 | 5 | 80238986 | 84314930 |
| 6233 | 5 | 80238986 | 84340523 |
| 6234 | 5 | 80238986 | 84516340 |
| 6235 | 5 | 80238986 | 84706916 |
| 6236 | 5 | 80238986 | 84799488 |
| 6237 | 5 | 80238986 | 84801081 |
| 6238 | 5 | 80238986 | 84824103 |
| 6239 | 5 | 80238986 | 84824203 |
| 6240 | 5 | 80238986 | 84824816 |
| 6241 | 5 | 80238986 | 84825422 |
| 6242 | 5 | 80238986 | 84825763 |
| 6243 | 5 | 80238986 | 84825942 |
| 6244 | 5 | 80238986 | 84843411 |
| 6245 | 5 | 80238986 | 84936441 |
| 6246 | 5 | 80238986 | 84936493 |
| 6247 | 5 | 80238986 | 84943705 |
| 6248 | 5 | 80238986 | 169454950 |
| 6249 | 5 | 80238986 | 181522829 |
| 6250 | 5 | 80238986 | 204759879 |
| 6251 | 5 | 80238986 | 209874191 |
| 6252 | 5 | 80239243 | 80241911 |
| 6253 | 5 | 80239243 | 80282785 |
| 6254 | 5 | 80239243 | 80345337 |
| 6255 | 5 | 80239243 | 80389787 |
| 6256 | 5 | 80239243 | 80411639 |
| 6257 | 5 | 80239243 | 80446855 |
| 6258 | 5 | 80239243 | 80492790 |
| 6259 | 5 | 80239243 | 80670554 |
| 6260 | 5 | 80239243 | 80674679 |
| 6261 | 5 | 80239243 | 80720509 |
| 6262 | 5 | 80239243 | 80800856 |
| 6263 | 5 | 80239243 | 80804587 |
| 6264 | 5 | 80239243 | 80807409 |
| 6265 | 5 | 80239243 | 80835734 |
| 6266 | 5 | 80239243 | 80971764 |

TABLE 1-continued

Examples of chromosomal segments associated with increased fertility in maize.

| Chromosomal Segment | Chr. | Boundary 1 | Boundary 2 |
|---|---|---|---|
| 6267 | 5 | 80239243 | 80972258 |
| 6268 | 5 | 80239243 | 80974450 |
| 6269 | 5 | 80239243 | 81047638 |
| 6270 | 5 | 80239243 | 81082921 |
| 6271 | 5 | 80239243 | 81157909 |
| 6272 | 5 | 80239243 | 81265937 |
| 6273 | 5 | 80239243 | 81265937 |
| 6274 | 5 | 80239243 | 81267485 |
| 6275 | 5 | 80239243 | 81267499 |
| 6276 | 5 | 80239243 | 81274512 |
| 6277 | 5 | 80239243 | 81763618 |
| 6278 | 5 | 80239243 | 81797217 |
| 6279 | 5 | 80239243 | 81800186 |
| 6280 | 5 | 80239243 | 81806213 |
| 6281 | 5 | 80239243 | 81854583 |
| 6282 | 5 | 80239243 | 81859374 |
| 6283 | 5 | 80239243 | 81861368 |
| 6284 | 5 | 80239243 | 81863686 |
| 6285 | 5 | 80239243 | 81916850 |
| 6286 | 5 | 80239243 | 81954891 |
| 6287 | 5 | 80239243 | 81985250 |
| 6288 | 5 | 80239243 | 82083752 |
| 6289 | 5 | 80239243 | 82101253 |
| 6290 | 5 | 80239243 | 82143124 |
| 6291 | 5 | 80239243 | 82236318 |
| 6292 | 5 | 80239243 | 82325587 |
| 6293 | 5 | 80239243 | 82427210 |
| 6294 | 5 | 80239243 | 82431853 |
| 6295 | 5 | 80239243 | 82446714 |
| 6296 | 5 | 80239243 | 82446794 |
| 6297 | 5 | 80239243 | 82551111 |
| 6298 | 5 | 80239243 | 82552090 |
| 6299 | 5 | 80239243 | 82555641 |
| 6300 | 5 | 80239243 | 82555670 |
| 6301 | 5 | 80239243 | 82556511 |
| 6302 | 5 | 80239243 | 82559047 |
| 6303 | 5 | 80239243 | 82561535 |
| 6304 | 5 | 80239243 | 82610100 |
| 6305 | 5 | 80239243 | 82676822 |
| 6306 | 5 | 80239243 | 82676901 |
| 6307 | 5 | 80239243 | 82883691 |
| 6308 | 5 | 80239243 | 82954942 |
| 6309 | 5 | 80239243 | 82971688 |
| 6310 | 5 | 80239243 | 83023965 |
| 6311 | 5 | 80239243 | 83094205 |
| 6312 | 5 | 80239243 | 83146355 |
| 6313 | 5 | 80239243 | 83280630 |
| 6314 | 5 | 80239243 | 83281412 |
| 6315 | 5 | 80239243 | 83400242 |
| 6316 | 5 | 80239243 | 83405797 |
| 6317 | 5 | 80239243 | 83437132 |
| 6318 | 5 | 80239243 | 83522252 |
| 6319 | 5 | 80239243 | 83560095 |
| 6320 | 5 | 80239243 | 83560204 |
| 6321 | 5 | 80239243 | 83572400 |
| 6322 | 5 | 80239243 | 83607661 |
| 6323 | 5 | 80239243 | 83745342 |
| 6324 | 5 | 80239243 | 83861275 |
| 6325 | 5 | 80239243 | 83861633 |
| 6326 | 5 | 80239243 | 83865653 |
| 6327 | 5 | 80239243 | 83865914 |
| 6328 | 5 | 80239243 | 83865920 |
| 6329 | 5 | 80239243 | 83868010 |
| 6330 | 5 | 80239243 | 84019752 |
| 6331 | 5 | 80239243 | 84065912 |
| 6332 | 5 | 80239243 | 84086632 |
| 6333 | 5 | 80239243 | 84089603 |
| 6334 | 5 | 80239243 | 84104814 |
| 6335 | 5 | 80239243 | 84105175 |
| 6336 | 5 | 80239243 | 84251635 |
| 6337 | 5 | 80239243 | 84252180 |
| 6338 | 5 | 80239243 | 84253030 |
| 6339 | 5 | 80239243 | 84254208 |
| 6340 | 5 | 80239243 | 84314930 |
| 6341 | 5 | 80239243 | 84340523 |
| 6342 | 5 | 80239243 | 84516340 |
| 6343 | 5 | 80239243 | 84706916 |
| 6344 | 5 | 80239243 | 84799488 |
| 6345 | 5 | 80239243 | 84801081 |
| 6346 | 5 | 80239243 | 84824103 |
| 6347 | 5 | 80239243 | 84824203 |
| 6348 | 5 | 80239243 | 84824816 |
| 6349 | 5 | 80239243 | 84825422 |
| 6350 | 5 | 80239243 | 84825763 |
| 6351 | 5 | 80239243 | 84825942 |
| 6352 | 5 | 80239243 | 84843411 |
| 6353 | 5 | 80239243 | 84936441 |
| 6354 | 5 | 80239243 | 84936493 |
| 6355 | 5 | 80239243 | 84943705 |
| 6356 | 5 | 80239243 | 169454950 |
| 6357 | 5 | 80239243 | 181522829 |
| 6358 | 5 | 80239243 | 204759879 |
| 6359 | 5 | 80239243 | 209874191 |
| 6360 | 5 | 80273499 | 80282785 |
| 6361 | 5 | 80273499 | 80345337 |
| 6362 | 5 | 80273499 | 80389787 |
| 6363 | 5 | 80273499 | 80411639 |
| 6364 | 5 | 80273499 | 80446855 |
| 6365 | 5 | 80273499 | 80492790 |
| 6366 | 5 | 80273499 | 80670554 |
| 6367 | 5 | 80273499 | 80674679 |
| 6368 | 5 | 80273499 | 80720509 |
| 6369 | 5 | 80273499 | 80800856 |
| 6370 | 5 | 80273499 | 80804587 |
| 6371 | 5 | 80273499 | 80807409 |
| 6372 | 5 | 80273499 | 80835734 |
| 6373 | 5 | 80273499 | 80971764 |
| 6374 | 5 | 80273499 | 80972258 |
| 6375 | 5 | 80273499 | 80974450 |
| 6376 | 5 | 80273499 | 81047638 |
| 6377 | 5 | 80273499 | 81082921 |
| 6378 | 5 | 80273499 | 81157909 |
| 6379 | 5 | 80273499 | 81265937 |
| 6380 | 5 | 80273499 | 81265937 |
| 6381 | 5 | 80273499 | 81267485 |
| 6382 | 5 | 80273499 | 81267499 |
| 6383 | 5 | 80273499 | 81274512 |
| 6384 | 5 | 80273499 | 81763618 |
| 6385 | 5 | 80273499 | 81797217 |
| 6386 | 5 | 80273499 | 81800186 |
| 6387 | 5 | 80273499 | 81806213 |
| 6388 | 5 | 80273499 | 81854583 |
| 6389 | 5 | 80273499 | 81859374 |
| 6390 | 5 | 80273499 | 81861368 |
| 6391 | 5 | 80273499 | 81863686 |
| 6392 | 5 | 80273499 | 81916850 |
| 6393 | 5 | 80273499 | 81954891 |
| 6394 | 5 | 80273499 | 81985250 |
| 6395 | 5 | 80273499 | 82083752 |
| 6396 | 5 | 80273499 | 82101253 |
| 6397 | 5 | 80273499 | 82143124 |
| 6398 | 5 | 80273499 | 82236318 |
| 6399 | 5 | 80273499 | 82325587 |
| 6400 | 5 | 80273499 | 82427210 |
| 6401 | 5 | 80273499 | 82431853 |
| 6402 | 5 | 80273499 | 82446714 |
| 6403 | 5 | 80273499 | 82446794 |
| 6404 | 5 | 80273499 | 82551111 |
| 6405 | 5 | 80273499 | 82552090 |
| 6406 | 5 | 80273499 | 82555641 |
| 6407 | 5 | 80273499 | 82555670 |
| 6408 | 5 | 80273499 | 82556511 |
| 6409 | 5 | 80273499 | 82559047 |
| 6410 | 5 | 80273499 | 82561535 |
| 6411 | 5 | 80273499 | 82610100 |
| 6412 | 5 | 80273499 | 82676822 |
| 6413 | 5 | 80273499 | 82676901 |
| 6414 | 5 | 80273499 | 82883691 |

TABLE 1-continued

Examples of chromosomal segments associated with increased fertility in maize.

| Chromosomal Segment | Chr. | Boundary 1 | Boundary 2 |
|---|---|---|---|
| 6415 | 5 | 80273499 | 82954942 |
| 6416 | 5 | 80273499 | 82971688 |
| 6417 | 5 | 80273499 | 83023965 |
| 6418 | 5 | 80273499 | 83094205 |
| 6419 | 5 | 80273499 | 83146355 |
| 6420 | 5 | 80273499 | 83280630 |
| 6421 | 5 | 80273499 | 83281412 |
| 6422 | 5 | 80273499 | 83400242 |
| 6423 | 5 | 80273499 | 83405797 |
| 6424 | 5 | 80273499 | 83437132 |
| 6425 | 5 | 80273499 | 83522252 |
| 6426 | 5 | 80273499 | 83560095 |
| 6427 | 5 | 80273499 | 83560204 |
| 6428 | 5 | 80273499 | 83572400 |
| 6429 | 5 | 80273499 | 83607661 |
| 6430 | 5 | 80273499 | 83745342 |
| 6431 | 5 | 80273499 | 83861275 |
| 6432 | 5 | 80273499 | 83861633 |
| 6433 | 5 | 80273499 | 83865653 |
| 6434 | 5 | 80273499 | 83865914 |
| 6435 | 5 | 80273499 | 83865920 |
| 6436 | 5 | 80273499 | 83868010 |
| 6437 | 5 | 80273499 | 84019752 |
| 6438 | 5 | 80273499 | 84065912 |
| 6439 | 5 | 80273499 | 84086632 |
| 6440 | 5 | 80273499 | 84089603 |
| 6441 | 5 | 80273499 | 84104814 |
| 6442 | 5 | 80273499 | 84105175 |
| 6443 | 5 | 80273499 | 84251635 |
| 6444 | 5 | 80273499 | 84252180 |
| 6445 | 5 | 80273499 | 84253030 |
| 6446 | 5 | 80273499 | 84254208 |
| 6447 | 5 | 80273499 | 84314930 |
| 6448 | 5 | 80273499 | 84340523 |
| 6449 | 5 | 80273499 | 84516340 |
| 6450 | 5 | 80273499 | 84706916 |
| 6451 | 5 | 80273499 | 84799488 |
| 6452 | 5 | 80273499 | 84801081 |
| 6453 | 5 | 80273499 | 84824103 |
| 6454 | 5 | 80273499 | 84824203 |
| 6455 | 5 | 80273499 | 84824816 |
| 6456 | 5 | 80273499 | 84825422 |
| 6457 | 5 | 80273499 | 84825763 |
| 6458 | 5 | 80273499 | 84825942 |
| 6459 | 5 | 80273499 | 84843411 |
| 6460 | 5 | 80273499 | 84936441 |
| 6461 | 5 | 80273499 | 84936493 |
| 6462 | 5 | 80273499 | 84943705 |
| 6463 | 5 | 80273499 | 169454950 |
| 6464 | 5 | 80273499 | 181522829 |
| 6465 | 5 | 80273499 | 204759879 |
| 6466 | 5 | 80273499 | 209874191 |
| 6467 | 5 | 80344025 | 80345337 |
| 6468 | 5 | 80344025 | 80389787 |
| 6469 | 5 | 80344025 | 80411639 |
| 6470 | 5 | 80344025 | 80446855 |
| 6471 | 5 | 80344025 | 80492790 |
| 6472 | 5 | 80344025 | 80670554 |
| 6473 | 5 | 80344025 | 80674679 |
| 6474 | 5 | 80344025 | 80720509 |
| 6475 | 5 | 80344025 | 80800856 |
| 6476 | 5 | 80344025 | 80804587 |
| 6477 | 5 | 80344025 | 80807409 |
| 6478 | 5 | 80344025 | 80835734 |
| 6479 | 5 | 80344025 | 80971764 |
| 6480 | 5 | 80344025 | 80972258 |
| 6481 | 5 | 80344025 | 80974450 |
| 6482 | 5 | 80344025 | 81047638 |
| 6483 | 5 | 80344025 | 81082921 |
| 6484 | 5 | 80344025 | 81157909 |
| 6485 | 5 | 80344025 | 81265937 |
| 6486 | 5 | 80344025 | 81265937 |
| 6487 | 5 | 80344025 | 81267485 |
| 6488 | 5 | 80344025 | 81267499 |
| 6489 | 5 | 80344025 | 81274512 |
| 6490 | 5 | 80344025 | 81763618 |
| 6491 | 5 | 80344025 | 81797217 |
| 6492 | 5 | 80344025 | 81800186 |
| 6493 | 5 | 80344025 | 81806213 |
| 6494 | 5 | 80344025 | 81854583 |
| 6495 | 5 | 80344025 | 81859374 |
| 6496 | 5 | 80344025 | 81861368 |
| 6497 | 5 | 80344025 | 81863686 |
| 6498 | 5 | 80344025 | 81916850 |
| 6499 | 5 | 80344025 | 81954891 |
| 6500 | 5 | 80344025 | 81985250 |
| 6501 | 5 | 80344025 | 82083752 |
| 6502 | 5 | 80344025 | 82101253 |
| 6503 | 5 | 80344025 | 82143124 |
| 6504 | 5 | 80344025 | 82236318 |
| 6505 | 5 | 80344025 | 82325587 |
| 6506 | 5 | 80344025 | 82427210 |
| 6507 | 5 | 80344025 | 82431853 |
| 6508 | 5 | 80344025 | 82446714 |
| 6509 | 5 | 80344025 | 82446794 |
| 6510 | 5 | 80344025 | 82551111 |
| 6511 | 5 | 80344025 | 82552090 |
| 6512 | 5 | 80344025 | 82555641 |
| 6513 | 5 | 80344025 | 82555670 |
| 6514 | 5 | 80344025 | 82556511 |
| 6515 | 5 | 80344025 | 82559047 |
| 6516 | 5 | 80344025 | 82561535 |
| 6517 | 5 | 80344025 | 82610100 |
| 6518 | 5 | 80344025 | 82676822 |
| 6519 | 5 | 80344025 | 82676901 |
| 6520 | 5 | 80344025 | 82883691 |
| 6521 | 5 | 80344025 | 82954942 |
| 6522 | 5 | 80344025 | 82971688 |
| 6523 | 5 | 80344025 | 83023965 |
| 6524 | 5 | 80344025 | 83094205 |
| 6525 | 5 | 80344025 | 83146355 |
| 6526 | 5 | 80344025 | 83280630 |
| 6527 | 5 | 80344025 | 83281412 |
| 6528 | 5 | 80344025 | 83400242 |
| 6529 | 5 | 80344025 | 83405797 |
| 6530 | 5 | 80344025 | 83437132 |
| 6531 | 5 | 80344025 | 83522252 |
| 6532 | 5 | 80344025 | 83560095 |
| 6533 | 5 | 80344025 | 83560204 |
| 6534 | 5 | 80344025 | 83572400 |
| 6535 | 5 | 80344025 | 83607661 |
| 6536 | 5 | 80344025 | 83745342 |
| 6537 | 5 | 80344025 | 83861275 |
| 6538 | 5 | 80344025 | 83861633 |
| 6539 | 5 | 80344025 | 83865653 |
| 6540 | 5 | 80344025 | 83865914 |
| 6541 | 5 | 80344025 | 83865920 |
| 6542 | 5 | 80344025 | 83868010 |
| 6543 | 5 | 80344025 | 84019752 |
| 6544 | 5 | 80344025 | 84065912 |
| 6545 | 5 | 80344025 | 84086632 |
| 6546 | 5 | 80344025 | 84089603 |
| 6547 | 5 | 80344025 | 84104814 |
| 6548 | 5 | 80344025 | 84105175 |
| 6549 | 5 | 80344025 | 84251635 |
| 6550 | 5 | 80344025 | 84252180 |
| 6551 | 5 | 80344025 | 84253030 |
| 6552 | 5 | 80344025 | 84254208 |
| 6553 | 5 | 80344025 | 84314930 |
| 6554 | 5 | 80344025 | 84340523 |
| 6555 | 5 | 80344025 | 84516340 |
| 6556 | 5 | 80344025 | 84706916 |
| 6557 | 5 | 80344025 | 84799488 |
| 6558 | 5 | 80344025 | 84801081 |
| 6559 | 5 | 80344025 | 84824103 |
| 6560 | 5 | 80344025 | 84824203 |
| 6561 | 5 | 80344025 | 84824816 |
| 6562 | 5 | 80344025 | 84825422 |

TABLE 1-continued

Examples of chromosomal segments associated with increased fertility in maize.

| Chromosomal Segment | Chr. | Boundary 1 | Boundary 2 |
|---|---|---|---|
| 6563 | 5 | 80344025 | 84825763 |
| 6564 | 5 | 80344025 | 84825942 |
| 6565 | 5 | 80344025 | 84843411 |
| 6566 | 5 | 80344025 | 84936441 |
| 6567 | 5 | 80344025 | 84936493 |
| 6568 | 5 | 80344025 | 84943705 |
| 6569 | 5 | 80344025 | 169454950 |
| 6570 | 5 | 80344025 | 181522829 |
| 6571 | 5 | 80344025 | 204759879 |
| 6572 | 5 | 80344025 | 209874191 |
| 6573 | 5 | 80387639 | 80389787 |
| 6574 | 5 | 80387639 | 80411639 |
| 6575 | 5 | 80387639 | 80446855 |
| 6576 | 5 | 80387639 | 80492790 |
| 6577 | 5 | 80387639 | 80670554 |
| 6578 | 5 | 80387639 | 80674679 |
| 6579 | 5 | 80387639 | 80720509 |
| 6580 | 5 | 80387639 | 80800856 |
| 6581 | 5 | 80387639 | 80804587 |
| 6582 | 5 | 80387639 | 80807409 |
| 6583 | 5 | 80387639 | 80835734 |
| 6584 | 5 | 80387639 | 80971764 |
| 6585 | 5 | 80387639 | 80972258 |
| 6586 | 5 | 80387639 | 80974450 |
| 6587 | 5 | 80387639 | 81047638 |
| 6588 | 5 | 80387639 | 81082921 |
| 6589 | 5 | 80387639 | 81157909 |
| 6590 | 5 | 80387639 | 81265937 |
| 6591 | 5 | 80387639 | 81265937 |
| 6592 | 5 | 80387639 | 81267485 |
| 6593 | 5 | 80387639 | 81267499 |
| 6594 | 5 | 80387639 | 81274512 |
| 6595 | 5 | 80387639 | 81763618 |
| 6596 | 5 | 80387639 | 81797217 |
| 6597 | 5 | 80387639 | 81800186 |
| 6598 | 5 | 80387639 | 81806213 |
| 6599 | 5 | 80387639 | 81854583 |
| 6600 | 5 | 80387639 | 81859374 |
| 6601 | 5 | 80387639 | 81861368 |
| 6602 | 5 | 80387639 | 81863686 |
| 6603 | 5 | 80387639 | 81916850 |
| 6604 | 5 | 80387639 | 81954891 |
| 6605 | 5 | 80387639 | 81985250 |
| 6606 | 5 | 80387639 | 82083752 |
| 6607 | 5 | 80387639 | 82101253 |
| 6608 | 5 | 80387639 | 82143124 |
| 6609 | 5 | 80387639 | 82236318 |
| 6610 | 5 | 80387639 | 82325587 |
| 6611 | 5 | 80387639 | 82427210 |
| 6612 | 5 | 80387639 | 82431853 |
| 6613 | 5 | 80387639 | 82446714 |
| 6614 | 5 | 80387639 | 82446794 |
| 6615 | 5 | 80387639 | 82551111 |
| 6616 | 5 | 80387639 | 82552090 |
| 6617 | 5 | 80387639 | 82555641 |
| 6618 | 5 | 80387639 | 82555670 |
| 6619 | 5 | 80387639 | 82556511 |
| 6620 | 5 | 80387639 | 82559047 |
| 6621 | 5 | 80387639 | 82561535 |
| 6622 | 5 | 80387639 | 82610100 |
| 6623 | 5 | 80387639 | 82676822 |
| 6624 | 5 | 80387639 | 82676901 |
| 6625 | 5 | 80387639 | 82883691 |
| 6626 | 5 | 80387639 | 82954942 |
| 6627 | 5 | 80387639 | 82971688 |
| 6628 | 5 | 80387639 | 83023965 |
| 6629 | 5 | 80387639 | 83094205 |
| 6630 | 5 | 80387639 | 83146355 |
| 6631 | 5 | 80387639 | 83280630 |
| 6632 | 5 | 80387639 | 83281412 |
| 6633 | 5 | 80387639 | 83400242 |
| 6634 | 5 | 80387639 | 83405797 |
| 6635 | 5 | 80387639 | 83437132 |
| 6636 | 5 | 80387639 | 83522252 |
| 6637 | 5 | 80387639 | 83560095 |
| 6638 | 5 | 80387639 | 83560204 |
| 6639 | 5 | 80387639 | 83572400 |
| 6640 | 5 | 80387639 | 83607661 |
| 6641 | 5 | 80387639 | 83745342 |
| 6642 | 5 | 80387639 | 83861275 |
| 6643 | 5 | 80387639 | 83861633 |
| 6644 | 5 | 80387639 | 83865653 |
| 6645 | 5 | 80387639 | 83865914 |
| 6646 | 5 | 80387639 | 83865920 |
| 6647 | 5 | 80387639 | 83868010 |
| 6648 | 5 | 80387639 | 84019752 |
| 6649 | 5 | 80387639 | 84065912 |
| 6650 | 5 | 80387639 | 84086632 |
| 6651 | 5 | 80387639 | 84089603 |
| 6652 | 5 | 80387639 | 84104814 |
| 6653 | 5 | 80387639 | 84105175 |
| 6654 | 5 | 80387639 | 84251635 |
| 6655 | 5 | 80387639 | 84252180 |
| 6656 | 5 | 80387639 | 84253030 |
| 6657 | 5 | 80387639 | 84254208 |
| 6658 | 5 | 80387639 | 84314930 |
| 6659 | 5 | 80387639 | 84340523 |
| 6660 | 5 | 80387639 | 84516340 |
| 6661 | 5 | 80387639 | 84706916 |
| 6662 | 5 | 80387639 | 84799488 |
| 6663 | 5 | 80387639 | 84801081 |
| 6664 | 5 | 80387639 | 84824103 |
| 6665 | 5 | 80387639 | 84824203 |
| 6666 | 5 | 80387639 | 84824816 |
| 6667 | 5 | 80387639 | 84825422 |
| 6668 | 5 | 80387639 | 84825763 |
| 6669 | 5 | 80387639 | 84825942 |
| 6670 | 5 | 80387639 | 84843411 |
| 6671 | 5 | 80387639 | 84936441 |
| 6672 | 5 | 80387639 | 84936493 |
| 6673 | 5 | 80387639 | 84943705 |
| 6674 | 5 | 80387639 | 169454950 |
| 6675 | 5 | 80387639 | 181522829 |
| 6676 | 5 | 80387639 | 204759879 |
| 6677 | 5 | 80387639 | 209874191 |
| 6678 | 5 | 80388596 | 80389787 |
| 6679 | 5 | 80388596 | 80411639 |
| 6680 | 5 | 80388596 | 80446855 |
| 6681 | 5 | 80388596 | 80492790 |
| 6682 | 5 | 80388596 | 80670554 |
| 6683 | 5 | 80388596 | 80674679 |
| 6684 | 5 | 80388596 | 80720509 |
| 6685 | 5 | 80388596 | 80800856 |
| 6686 | 5 | 80388596 | 80804587 |
| 6687 | 5 | 80388596 | 80807409 |
| 6688 | 5 | 80388596 | 80835734 |
| 6689 | 5 | 80388596 | 80971764 |
| 6690 | 5 | 80388596 | 80972258 |
| 6691 | 5 | 80388596 | 80974450 |
| 6692 | 5 | 80388596 | 81047638 |
| 6693 | 5 | 80388596 | 81082921 |
| 6694 | 5 | 80388596 | 81157909 |
| 6695 | 5 | 80388596 | 81265937 |
| 6696 | 5 | 80388596 | 81265937 |
| 6697 | 5 | 80388596 | 81267485 |
| 6698 | 5 | 80388596 | 81267499 |
| 6699 | 5 | 80388596 | 81274512 |
| 6700 | 5 | 80388596 | 81763618 |
| 6701 | 5 | 80388596 | 81797217 |
| 6702 | 5 | 80388596 | 81800186 |
| 6703 | 5 | 80388596 | 81806213 |
| 6704 | 5 | 80388596 | 81854583 |
| 6705 | 5 | 80388596 | 81859374 |
| 6706 | 5 | 80388596 | 81861368 |
| 6707 | 5 | 80388596 | 81863686 |
| 6708 | 5 | 80388596 | 81916850 |
| 6709 | 5 | 80388596 | 81954891 |
| 6710 | 5 | 80388596 | 81985250 |

TABLE 1-continued

Examples of chromosomal segments associated with increased fertility in maize.

| Chromosomal Segment | Chr. | Boundary 1 | Boundary 2 |
|---|---|---|---|
| 6711 | 5 | 80388596 | 82083752 |
| 6712 | 5 | 80388596 | 82101253 |
| 6713 | 5 | 80388596 | 82143124 |
| 6714 | 5 | 80388596 | 82236318 |
| 6715 | 5 | 80388596 | 82325587 |
| 6716 | 5 | 80388596 | 82427210 |
| 6717 | 5 | 80388596 | 82431853 |
| 6718 | 5 | 80388596 | 82446714 |
| 6719 | 5 | 80388596 | 82446794 |
| 6720 | 5 | 80388596 | 82551111 |
| 6721 | 5 | 80388596 | 82552090 |
| 6722 | 5 | 80388596 | 82555641 |
| 6723 | 5 | 80388596 | 82555670 |
| 6724 | 5 | 80388596 | 82556511 |
| 6725 | 5 | 80388596 | 82559047 |
| 6726 | 5 | 80388596 | 82561535 |
| 6727 | 5 | 80388596 | 82610100 |
| 6728 | 5 | 80388596 | 82676822 |
| 6729 | 5 | 80388596 | 82676901 |
| 6730 | 5 | 80388596 | 82883691 |
| 6731 | 5 | 80388596 | 82954942 |
| 6732 | 5 | 80388596 | 82971688 |
| 6733 | 5 | 80388596 | 83023965 |
| 6734 | 5 | 80388596 | 83094205 |
| 6735 | 5 | 80388596 | 83146355 |
| 6736 | 5 | 80388596 | 83280630 |
| 6737 | 5 | 80388596 | 83281412 |
| 6738 | 5 | 80388596 | 83400242 |
| 6739 | 5 | 80388596 | 83405797 |
| 6740 | 5 | 80388596 | 83437132 |
| 6741 | 5 | 80388596 | 83522252 |
| 6742 | 5 | 80388596 | 83560095 |
| 6743 | 5 | 80388596 | 83560204 |
| 6744 | 5 | 80388596 | 83572400 |
| 6745 | 5 | 80388596 | 83607661 |
| 6746 | 5 | 80388596 | 83745342 |
| 6747 | 5 | 80388596 | 83861275 |
| 6748 | 5 | 80388596 | 83861633 |
| 6749 | 5 | 80388596 | 83865653 |
| 6750 | 5 | 80388596 | 83865914 |
| 6751 | 5 | 80388596 | 83865920 |
| 6752 | 5 | 80388596 | 83868010 |
| 6753 | 5 | 80388596 | 84019752 |
| 6754 | 5 | 80388596 | 84065912 |
| 6755 | 5 | 80388596 | 84086632 |
| 6756 | 5 | 80388596 | 84089603 |
| 6757 | 5 | 80388596 | 84104814 |
| 6758 | 5 | 80388596 | 84105175 |
| 6759 | 5 | 80388596 | 84251635 |
| 6760 | 5 | 80388596 | 84252180 |
| 6761 | 5 | 80388596 | 84253030 |
| 6762 | 5 | 80388596 | 84254208 |
| 6763 | 5 | 80388596 | 84314930 |
| 6764 | 5 | 80388596 | 84340523 |
| 6765 | 5 | 80388596 | 84516340 |
| 6766 | 5 | 80388596 | 84706916 |
| 6767 | 5 | 80388596 | 84799488 |
| 6768 | 5 | 80388596 | 84801081 |
| 6769 | 5 | 80388596 | 84824103 |
| 6770 | 5 | 80388596 | 84824203 |
| 6771 | 5 | 80388596 | 84824816 |
| 6772 | 5 | 80388596 | 84825422 |
| 6773 | 5 | 80388596 | 84825763 |
| 6774 | 5 | 80388596 | 84825942 |
| 6775 | 5 | 80388596 | 84843411 |
| 6776 | 5 | 80388596 | 84936441 |
| 6777 | 5 | 80388596 | 84936493 |
| 6778 | 5 | 80388596 | 84943705 |
| 6779 | 5 | 80388596 | 169454950 |
| 6780 | 5 | 80388596 | 181522829 |
| 6781 | 5 | 80388596 | 204759879 |
| 6782 | 5 | 80388596 | 209874191 |
| 6783 | 5 | 80411337 | 80411639 |
| 6784 | 5 | 80411337 | 80446855 |
| 6785 | 5 | 80411337 | 80492790 |
| 6786 | 5 | 80411337 | 80670554 |
| 6787 | 5 | 80411337 | 80674679 |
| 6788 | 5 | 80411337 | 80720509 |
| 6789 | 5 | 80411337 | 80800856 |
| 6790 | 5 | 80411337 | 80804587 |
| 6791 | 5 | 80411337 | 80807409 |
| 6792 | 5 | 80411337 | 80835734 |
| 6793 | 5 | 80411337 | 80971764 |
| 6794 | 5 | 80411337 | 80972258 |
| 6795 | 5 | 80411337 | 80974450 |
| 6796 | 5 | 80411337 | 81047638 |
| 6797 | 5 | 80411337 | 81082921 |
| 6798 | 5 | 80411337 | 81157909 |
| 6799 | 5 | 80411337 | 81265937 |
| 6800 | 5 | 80411337 | 81265937 |
| 6801 | 5 | 80411337 | 81267485 |
| 6802 | 5 | 80411337 | 81267499 |
| 6803 | 5 | 80411337 | 81274512 |
| 6804 | 5 | 80411337 | 81763618 |
| 6805 | 5 | 80411337 | 81797217 |
| 6806 | 5 | 80411337 | 81800186 |
| 6807 | 5 | 80411337 | 81806213 |
| 6808 | 5 | 80411337 | 81854583 |
| 6809 | 5 | 80411337 | 81859374 |
| 6810 | 5 | 80411337 | 81861368 |
| 6811 | 5 | 80411337 | 81863686 |
| 6812 | 5 | 80411337 | 81916850 |
| 6813 | 5 | 80411337 | 81954891 |
| 6814 | 5 | 80411337 | 81985250 |
| 6815 | 5 | 80411337 | 82083752 |
| 6816 | 5 | 80411337 | 82101253 |
| 6817 | 5 | 80411337 | 82143124 |
| 6818 | 5 | 80411337 | 82236318 |
| 6819 | 5 | 80411337 | 82325587 |
| 6820 | 5 | 80411337 | 82427210 |
| 6821 | 5 | 80411337 | 82431853 |
| 6822 | 5 | 80411337 | 82446714 |
| 6823 | 5 | 80411337 | 82446794 |
| 6824 | 5 | 80411337 | 82551111 |
| 6825 | 5 | 80411337 | 82552090 |
| 6826 | 5 | 80411337 | 82555641 |
| 6827 | 5 | 80411337 | 82555670 |
| 6828 | 5 | 80411337 | 82556511 |
| 6829 | 5 | 80411337 | 82559047 |
| 6830 | 5 | 80411337 | 82561535 |
| 6831 | 5 | 80411337 | 82610100 |
| 6832 | 5 | 80411337 | 82676822 |
| 6833 | 5 | 80411337 | 82676901 |
| 6834 | 5 | 80411337 | 82883691 |
| 6835 | 5 | 80411337 | 82954942 |
| 6836 | 5 | 80411337 | 82971688 |
| 6837 | 5 | 80411337 | 83023965 |
| 6838 | 5 | 80411337 | 83094205 |
| 6839 | 5 | 80411337 | 83146355 |
| 6840 | 5 | 80411337 | 83280630 |
| 6841 | 5 | 80411337 | 83281412 |
| 6842 | 5 | 80411337 | 83400242 |
| 6843 | 5 | 80411337 | 83405797 |
| 6844 | 5 | 80411337 | 83437132 |
| 6845 | 5 | 80411337 | 83522252 |
| 6846 | 5 | 80411337 | 83560095 |
| 6847 | 5 | 80411337 | 83560204 |
| 6848 | 5 | 80411337 | 83572400 |
| 6849 | 5 | 80411337 | 83607661 |
| 6850 | 5 | 80411337 | 83745342 |
| 6851 | 5 | 80411337 | 83861275 |
| 6852 | 5 | 80411337 | 83861633 |
| 6853 | 5 | 80411337 | 83865653 |
| 6854 | 5 | 80411337 | 83865914 |
| 6855 | 5 | 80411337 | 83865920 |
| 6856 | 5 | 80411337 | 83868010 |
| 6857 | 5 | 80411337 | 84019752 |
| 6858 | 5 | 80411337 | 84065912 |

TABLE 1-continued

Examples of chromosomal segments associated with increased fertility in maize.

| Chromosomal Segment | Chr. | Boundary 1 | Boundary 2 |
|---|---|---|---|
| 6859 | 5 | 80411337 | 84086632 |
| 6860 | 5 | 80411337 | 84089603 |
| 6861 | 5 | 80411337 | 84104814 |
| 6862 | 5 | 80411337 | 84105175 |
| 6863 | 5 | 80411337 | 84251635 |
| 6864 | 5 | 80411337 | 84252180 |
| 6865 | 5 | 80411337 | 84253030 |
| 6866 | 5 | 80411337 | 84254208 |
| 6867 | 5 | 80411337 | 84314930 |
| 6868 | 5 | 80411337 | 84340523 |
| 6869 | 5 | 80411337 | 84516340 |
| 6870 | 5 | 80411337 | 84706916 |
| 6871 | 5 | 80411337 | 84799488 |
| 6872 | 5 | 80411337 | 84801081 |
| 6873 | 5 | 80411337 | 84824103 |
| 6874 | 5 | 80411337 | 84824203 |
| 6875 | 5 | 80411337 | 84824816 |
| 6876 | 5 | 80411337 | 84825422 |
| 6877 | 5 | 80411337 | 84825763 |
| 6878 | 5 | 80411337 | 84825942 |
| 6879 | 5 | 80411337 | 84843411 |
| 6880 | 5 | 80411337 | 84936441 |
| 6881 | 5 | 80411337 | 84936493 |
| 6882 | 5 | 80411337 | 84943705 |
| 6883 | 5 | 80411337 | 169454950 |
| 6884 | 5 | 80411337 | 181522829 |
| 6885 | 5 | 80411337 | 204759879 |
| 6886 | 5 | 80411337 | 209874191 |
| 6887 | 5 | 80446281 | 80446855 |
| 6888 | 5 | 80446281 | 80492790 |
| 6889 | 5 | 80446281 | 80670554 |
| 6890 | 5 | 80446281 | 80674679 |
| 6891 | 5 | 80446281 | 80720509 |
| 6892 | 5 | 80446281 | 80800856 |
| 6893 | 5 | 80446281 | 80804587 |
| 6894 | 5 | 80446281 | 80807409 |
| 6895 | 5 | 80446281 | 80835734 |
| 6896 | 5 | 80446281 | 80971764 |
| 6897 | 5 | 80446281 | 80972258 |
| 6898 | 5 | 80446281 | 80974450 |
| 6899 | 5 | 80446281 | 81047638 |
| 6900 | 5 | 80446281 | 81082921 |
| 6901 | 5 | 80446281 | 81157909 |
| 6902 | 5 | 80446281 | 81265937 |
| 6903 | 5 | 80446281 | 81265937 |
| 6904 | 5 | 80446281 | 81267485 |
| 6905 | 5 | 80446281 | 81267499 |
| 6906 | 5 | 80446281 | 81274512 |
| 6907 | 5 | 80446281 | 81763618 |
| 6908 | 5 | 80446281 | 81797217 |
| 6909 | 5 | 80446281 | 81800186 |
| 6910 | 5 | 80446281 | 81806213 |
| 6911 | 5 | 80446281 | 81854583 |
| 6912 | 5 | 80446281 | 81859374 |
| 6913 | 5 | 80446281 | 81861368 |
| 6914 | 5 | 80446281 | 81863686 |
| 6915 | 5 | 80446281 | 81916850 |
| 6916 | 5 | 80446281 | 81954891 |
| 6917 | 5 | 80446281 | 81985250 |
| 6918 | 5 | 80446281 | 82083752 |
| 6919 | 5 | 80446281 | 82101253 |
| 6920 | 5 | 80446281 | 82143124 |
| 6921 | 5 | 80446281 | 82236318 |
| 6922 | 5 | 80446281 | 82325587 |
| 6923 | 5 | 80446281 | 82427210 |
| 6924 | 5 | 80446281 | 82431853 |
| 6925 | 5 | 80446281 | 82446714 |
| 6926 | 5 | 80446281 | 82446794 |
| 6927 | 5 | 80446281 | 82551111 |
| 6928 | 5 | 80446281 | 82552090 |
| 6929 | 5 | 80446281 | 82555641 |
| 6930 | 5 | 80446281 | 82555670 |
| 6931 | 5 | 80446281 | 82556511 |
| 6932 | 5 | 80446281 | 82559047 |
| 6933 | 5 | 80446281 | 82561535 |
| 6934 | 5 | 80446281 | 82610100 |
| 6935 | 5 | 80446281 | 82676822 |
| 6936 | 5 | 80446281 | 82676901 |
| 6937 | 5 | 80446281 | 82883691 |
| 6938 | 5 | 80446281 | 82954942 |
| 6939 | 5 | 80446281 | 82971688 |
| 6940 | 5 | 80446281 | 83023965 |
| 6941 | 5 | 80446281 | 83094205 |
| 6942 | 5 | 80446281 | 83146355 |
| 6943 | 5 | 80446281 | 83280630 |
| 6944 | 5 | 80446281 | 83281412 |
| 6945 | 5 | 80446281 | 83400242 |
| 6946 | 5 | 80446281 | 83405797 |
| 6947 | 5 | 80446281 | 83437132 |
| 6948 | 5 | 80446281 | 83522252 |
| 6949 | 5 | 80446281 | 83560095 |
| 6950 | 5 | 80446281 | 83560204 |
| 6951 | 5 | 80446281 | 83572400 |
| 6952 | 5 | 80446281 | 83607661 |
| 6953 | 5 | 80446281 | 83745342 |
| 6954 | 5 | 80446281 | 83861275 |
| 6955 | 5 | 80446281 | 83861633 |
| 6956 | 5 | 80446281 | 83865653 |
| 6957 | 5 | 80446281 | 83865914 |
| 6958 | 5 | 80446281 | 83865920 |
| 6959 | 5 | 80446281 | 83868010 |
| 6960 | 5 | 80446281 | 84019752 |
| 6961 | 5 | 80446281 | 84065912 |
| 6962 | 5 | 80446281 | 84086632 |
| 6963 | 5 | 80446281 | 84089603 |
| 6964 | 5 | 80446281 | 84104814 |
| 6965 | 5 | 80446281 | 84105175 |
| 6966 | 5 | 80446281 | 84251635 |
| 6967 | 5 | 80446281 | 84252180 |
| 6968 | 5 | 80446281 | 84253030 |
| 6969 | 5 | 80446281 | 84254208 |
| 6970 | 5 | 80446281 | 84314930 |
| 6971 | 5 | 80446281 | 84340523 |
| 6972 | 5 | 80446281 | 84516340 |
| 6973 | 5 | 80446281 | 84706916 |
| 6974 | 5 | 80446281 | 84799488 |
| 6975 | 5 | 80446281 | 84801081 |
| 6976 | 5 | 80446281 | 84824103 |
| 6977 | 5 | 80446281 | 84824203 |
| 6978 | 5 | 80446281 | 84824816 |
| 6979 | 5 | 80446281 | 84825422 |
| 6980 | 5 | 80446281 | 84825763 |
| 6981 | 5 | 80446281 | 84825942 |
| 6982 | 5 | 80446281 | 84843411 |
| 6983 | 5 | 80446281 | 84936441 |
| 6984 | 5 | 80446281 | 84936493 |
| 6985 | 5 | 80446281 | 84943705 |
| 6986 | 5 | 80446281 | 169454950 |
| 6987 | 5 | 80446281 | 181522829 |
| 6988 | 5 | 80446281 | 204759879 |
| 6989 | 5 | 80446281 | 209874191 |
| 6990 | 5 | 80491807 | 80492790 |
| 6991 | 5 | 80491807 | 80670554 |
| 6992 | 5 | 80491807 | 80674679 |
| 6993 | 5 | 80491807 | 80720509 |
| 6994 | 5 | 80491807 | 80800856 |
| 6995 | 5 | 80491807 | 80804587 |
| 6996 | 5 | 80491807 | 80807409 |
| 6997 | 5 | 80491807 | 80835734 |
| 6998 | 5 | 80491807 | 80971764 |
| 6999 | 5 | 80491807 | 80972258 |
| 7000 | 5 | 80491807 | 80974450 |
| 7001 | 5 | 80491807 | 81047638 |
| 7002 | 5 | 80491807 | 81082921 |
| 7003 | 5 | 80491807 | 81157909 |
| 7004 | 5 | 80491807 | 81265937 |
| 7005 | 5 | 80491807 | 81265937 |
| 7006 | 5 | 80491807 | 81267485 |

TABLE 1-continued

Examples of chromosomal segments associated with increased fertility in maize.

| Chromosomal Segment | Chr. | Boundary 1 | Boundary 2 |
|---|---|---|---|
| 7007 | 5 | 80491807 | 81267499 |
| 7008 | 5 | 80491807 | 81274512 |
| 7009 | 5 | 80491807 | 81763618 |
| 7010 | 5 | 80491807 | 81797217 |
| 7011 | 5 | 80491807 | 81800186 |
| 7012 | 5 | 80491807 | 81806213 |
| 7013 | 5 | 80491807 | 81854583 |
| 7014 | 5 | 80491807 | 81859374 |
| 7015 | 5 | 80491807 | 81861368 |
| 7016 | 5 | 80491807 | 81863686 |
| 7017 | 5 | 80491807 | 81916850 |
| 7018 | 5 | 80491807 | 81954891 |
| 7019 | 5 | 80491807 | 81985250 |
| 7020 | 5 | 80491807 | 82083752 |
| 7021 | 5 | 80491807 | 82101253 |
| 7022 | 5 | 80491807 | 82143124 |
| 7023 | 5 | 80491807 | 82236318 |
| 7024 | 5 | 80491807 | 82325587 |
| 7025 | 5 | 80491807 | 82427210 |
| 7026 | 5 | 80491807 | 82431853 |
| 7027 | 5 | 80491807 | 82446714 |
| 7028 | 5 | 80491807 | 82446794 |
| 7029 | 5 | 80491807 | 82551111 |
| 7030 | 5 | 80491807 | 82552090 |
| 7031 | 5 | 80491807 | 82555641 |
| 7032 | 5 | 80491807 | 82555670 |
| 7033 | 5 | 80491807 | 82556511 |
| 7034 | 5 | 80491807 | 82559047 |
| 7035 | 5 | 80491807 | 82561535 |
| 7036 | 5 | 80491807 | 82610100 |
| 7037 | 5 | 80491807 | 82676822 |
| 7038 | 5 | 80491807 | 82676901 |
| 7039 | 5 | 80491807 | 82883691 |
| 7040 | 5 | 80491807 | 82954942 |
| 7041 | 5 | 80491807 | 82971688 |
| 7042 | 5 | 80491807 | 83023965 |
| 7043 | 5 | 80491807 | 83094205 |
| 7044 | 5 | 80491807 | 83146355 |
| 7045 | 5 | 80491807 | 83280630 |
| 7046 | 5 | 80491807 | 83281412 |
| 7047 | 5 | 80491807 | 83400242 |
| 7048 | 5 | 80491807 | 83405797 |
| 7049 | 5 | 80491807 | 83437132 |
| 7050 | 5 | 80491807 | 83522252 |
| 7051 | 5 | 80491807 | 83560095 |
| 7052 | 5 | 80491807 | 83560204 |
| 7053 | 5 | 80491807 | 83572400 |
| 7054 | 5 | 80491807 | 83607661 |
| 7055 | 5 | 80491807 | 83745342 |
| 7056 | 5 | 80491807 | 83861275 |
| 7057 | 5 | 80491807 | 83861633 |
| 7058 | 5 | 80491807 | 83865653 |
| 7059 | 5 | 80491807 | 83865914 |
| 7060 | 5 | 80491807 | 83865920 |
| 7061 | 5 | 80491807 | 83868010 |
| 7062 | 5 | 80491807 | 84019752 |
| 7063 | 5 | 80491807 | 84065912 |
| 7064 | 5 | 80491807 | 84086632 |
| 7065 | 5 | 80491807 | 84089603 |
| 7066 | 5 | 80491807 | 84104814 |
| 7067 | 5 | 80491807 | 84105175 |
| 7068 | 5 | 80491807 | 84251635 |
| 7069 | 5 | 80491807 | 84252180 |
| 7070 | 5 | 80491807 | 84253030 |
| 7071 | 5 | 80491807 | 84254208 |
| 7072 | 5 | 80491807 | 84314930 |
| 7073 | 5 | 80491807 | 84340523 |
| 7074 | 5 | 80491807 | 84516340 |
| 7075 | 5 | 80491807 | 84706916 |
| 7076 | 5 | 80491807 | 84799488 |
| 7077 | 5 | 80491807 | 84801081 |
| 7078 | 5 | 80491807 | 84824103 |
| 7079 | 5 | 80491807 | 84824203 |
| 7080 | 5 | 80491807 | 84824816 |
| 7081 | 5 | 80491807 | 84825422 |
| 7082 | 5 | 80491807 | 84825763 |
| 7083 | 5 | 80491807 | 84825942 |
| 7084 | 5 | 80491807 | 84843411 |
| 7085 | 5 | 80491807 | 84936441 |
| 7086 | 5 | 80491807 | 84936493 |
| 7087 | 5 | 80491807 | 84943705 |
| 7088 | 5 | 80491807 | 169454950 |
| 7089 | 5 | 80491807 | 181522829 |
| 7090 | 5 | 80491807 | 204759879 |
| 7091 | 5 | 80491807 | 209874191 |
| 7092 | 5 | 80669160 | 80670554 |
| 7093 | 5 | 80669160 | 80674679 |
| 7094 | 5 | 80669160 | 80720509 |
| 7095 | 5 | 80669160 | 80800856 |
| 7096 | 5 | 80669160 | 80804587 |
| 7097 | 5 | 80669160 | 80807409 |
| 7098 | 5 | 80669160 | 80835734 |
| 7099 | 5 | 80669160 | 80971764 |
| 7100 | 5 | 80669160 | 80972258 |
| 7101 | 5 | 80669160 | 80974450 |
| 7102 | 5 | 80669160 | 81047638 |
| 7103 | 5 | 80669160 | 81082921 |
| 7104 | 5 | 80669160 | 81157909 |
| 7105 | 5 | 80669160 | 81265937 |
| 7106 | 5 | 80669160 | 81265937 |
| 7107 | 5 | 80669160 | 81267485 |
| 7108 | 5 | 80669160 | 81267499 |
| 7109 | 5 | 80669160 | 81274512 |
| 7110 | 5 | 80669160 | 81763618 |
| 7111 | 5 | 80669160 | 81797217 |
| 7112 | 5 | 80669160 | 81800186 |
| 7113 | 5 | 80669160 | 81806213 |
| 7114 | 5 | 80669160 | 81854583 |
| 7115 | 5 | 80669160 | 81859374 |
| 7116 | 5 | 80669160 | 81861368 |
| 7117 | 5 | 80669160 | 81863686 |
| 7118 | 5 | 80669160 | 81916850 |
| 7119 | 5 | 80669160 | 81954891 |
| 7120 | 5 | 80669160 | 81985250 |
| 7121 | 5 | 80669160 | 82083752 |
| 7122 | 5 | 80669160 | 82101253 |
| 7123 | 5 | 80669160 | 82143124 |
| 7124 | 5 | 80669160 | 82236318 |
| 7125 | 5 | 80669160 | 82325587 |
| 7126 | 5 | 80669160 | 82427210 |
| 7127 | 5 | 80669160 | 82431853 |
| 7128 | 5 | 80669160 | 82446714 |
| 7129 | 5 | 80669160 | 82446794 |
| 7130 | 5 | 80669160 | 82551111 |
| 7131 | 5 | 80669160 | 82552090 |
| 7132 | 5 | 80669160 | 82555641 |
| 7133 | 5 | 80669160 | 82555670 |
| 7134 | 5 | 80669160 | 82556511 |
| 7135 | 5 | 80669160 | 82559047 |
| 7136 | 5 | 80669160 | 82561535 |
| 7137 | 5 | 80669160 | 82610100 |
| 7138 | 5 | 80669160 | 82676822 |
| 7139 | 5 | 80669160 | 82676901 |
| 7140 | 5 | 80669160 | 82883691 |
| 7141 | 5 | 80669160 | 82954942 |
| 7142 | 5 | 80669160 | 82971688 |
| 7143 | 5 | 80669160 | 83023965 |
| 7144 | 5 | 80669160 | 83094205 |
| 7145 | 5 | 80669160 | 83146355 |
| 7146 | 5 | 80669160 | 83280630 |
| 7147 | 5 | 80669160 | 83281412 |
| 7148 | 5 | 80669160 | 83400242 |
| 7149 | 5 | 80669160 | 83405797 |
| 7150 | 5 | 80669160 | 83437132 |
| 7151 | 5 | 80669160 | 83522252 |
| 7152 | 5 | 80669160 | 83560095 |
| 7153 | 5 | 80669160 | 83560204 |
| 7154 | 5 | 80669160 | 83572400 |

TABLE 1-continued

Examples of chromosomal segments associated with increased fertility in maize.

| Chromosomal Segment | Chr. | Boundary 1 | Boundary 2 |
|---|---|---|---|
| 7155 | 5 | 80669160 | 83607661 |
| 7156 | 5 | 80669160 | 83745342 |
| 7157 | 5 | 80669160 | 83861275 |
| 7158 | 5 | 80669160 | 83861633 |
| 7159 | 5 | 80669160 | 83865653 |
| 7160 | 5 | 80669160 | 83865914 |
| 7161 | 5 | 80669160 | 83865920 |
| 7162 | 5 | 80669160 | 83868010 |
| 7163 | 5 | 80669160 | 84019752 |
| 7164 | 5 | 80669160 | 84065912 |
| 7165 | 5 | 80669160 | 84086632 |
| 7166 | 5 | 80669160 | 84089603 |
| 7167 | 5 | 80669160 | 84104814 |
| 7168 | 5 | 80669160 | 84105175 |
| 7169 | 5 | 80669160 | 84251635 |
| 7170 | 5 | 80669160 | 84252180 |
| 7171 | 5 | 80669160 | 84253030 |
| 7172 | 5 | 80669160 | 84254208 |
| 7173 | 5 | 80669160 | 84314930 |
| 7174 | 5 | 80669160 | 84340523 |
| 7175 | 5 | 80669160 | 84516340 |
| 7176 | 5 | 80669160 | 84706916 |
| 7177 | 5 | 80669160 | 84799488 |
| 7178 | 5 | 80669160 | 84801081 |
| 7179 | 5 | 80669160 | 84824103 |
| 7180 | 5 | 80669160 | 84824203 |
| 7181 | 5 | 80669160 | 84824816 |
| 7182 | 5 | 80669160 | 84825422 |
| 7183 | 5 | 80669160 | 84825763 |
| 7184 | 5 | 80669160 | 84825942 |
| 7185 | 5 | 80669160 | 84843411 |
| 7186 | 5 | 80669160 | 84936441 |
| 7187 | 5 | 80669160 | 84936493 |
| 7188 | 5 | 80669160 | 84943705 |
| 7189 | 5 | 80669160 | 169454950 |
| 7190 | 5 | 80669160 | 181522829 |
| 7191 | 5 | 80669160 | 204759879 |
| 7192 | 5 | 80669160 | 209874191 |
| 7193 | 5 | 80715081 | 80720509 |
| 7194 | 5 | 80715081 | 80800856 |
| 7195 | 5 | 80715081 | 80804587 |
| 7196 | 5 | 80715081 | 80807409 |
| 7197 | 5 | 80715081 | 80835734 |
| 7198 | 5 | 80715081 | 80971764 |
| 7199 | 5 | 80715081 | 80972258 |
| 7200 | 5 | 80715081 | 80974450 |
| 7201 | 5 | 80715081 | 81047638 |
| 7202 | 5 | 80715081 | 81082921 |
| 7203 | 5 | 80715081 | 81157909 |
| 7204 | 5 | 80715081 | 81265937 |
| 7205 | 5 | 80715081 | 81265937 |
| 7206 | 5 | 80715081 | 81267485 |
| 7207 | 5 | 80715081 | 81267499 |
| 7208 | 5 | 80715081 | 81274512 |
| 7209 | 5 | 80715081 | 81763618 |
| 7210 | 5 | 80715081 | 81797217 |
| 7211 | 5 | 80715081 | 81800186 |
| 7212 | 5 | 80715081 | 81806213 |
| 7213 | 5 | 80715081 | 81854583 |
| 7214 | 5 | 80715081 | 81859374 |
| 7215 | 5 | 80715081 | 81861368 |
| 7216 | 5 | 80715081 | 81863686 |
| 7217 | 5 | 80715081 | 81916850 |
| 7218 | 5 | 80715081 | 81954891 |
| 7219 | 5 | 80715081 | 81985250 |
| 7220 | 5 | 80715081 | 82083752 |
| 7221 | 5 | 80715081 | 82101253 |
| 7222 | 5 | 80715081 | 82143124 |
| 7223 | 5 | 80715081 | 82236318 |
| 7224 | 5 | 80715081 | 82325587 |
| 7225 | 5 | 80715081 | 82427210 |
| 7226 | 5 | 80715081 | 82431853 |
| 7227 | 5 | 80715081 | 82446714 |
| 7228 | 5 | 80715081 | 82446794 |
| 7229 | 5 | 80715081 | 82551111 |
| 7230 | 5 | 80715081 | 82552090 |
| 7231 | 5 | 80715081 | 82555641 |
| 7232 | 5 | 80715081 | 82555670 |
| 7233 | 5 | 80715081 | 82556511 |
| 7234 | 5 | 80715081 | 82559047 |
| 7235 | 5 | 80715081 | 82561535 |
| 7236 | 5 | 80715081 | 82610100 |
| 7237 | 5 | 80715081 | 82676822 |
| 7238 | 5 | 80715081 | 82676901 |
| 7239 | 5 | 80715081 | 82883691 |
| 7240 | 5 | 80715081 | 82954942 |
| 7241 | 5 | 80715081 | 82971688 |
| 7242 | 5 | 80715081 | 83023965 |
| 7243 | 5 | 80715081 | 83094205 |
| 7244 | 5 | 80715081 | 83146355 |
| 7245 | 5 | 80715081 | 83280630 |
| 7246 | 5 | 80715081 | 83281412 |
| 7247 | 5 | 80715081 | 83400242 |
| 7248 | 5 | 80715081 | 83405797 |
| 7249 | 5 | 80715081 | 83437132 |
| 7250 | 5 | 80715081 | 83522252 |
| 7251 | 5 | 80715081 | 83560095 |
| 7252 | 5 | 80715081 | 83560204 |
| 7253 | 5 | 80715081 | 83572400 |
| 7254 | 5 | 80715081 | 83607661 |
| 7255 | 5 | 80715081 | 83745342 |
| 7256 | 5 | 80715081 | 83861275 |
| 7257 | 5 | 80715081 | 83861633 |
| 7258 | 5 | 80715081 | 83865653 |
| 7259 | 5 | 80715081 | 83865914 |
| 7260 | 5 | 80715081 | 83865920 |
| 7261 | 5 | 80715081 | 83868010 |
| 7262 | 5 | 80715081 | 84019752 |
| 7263 | 5 | 80715081 | 84065912 |
| 7264 | 5 | 80715081 | 84086632 |
| 7265 | 5 | 80715081 | 84089603 |
| 7266 | 5 | 80715081 | 84104814 |
| 7267 | 5 | 80715081 | 84105175 |
| 7268 | 5 | 80715081 | 84251635 |
| 7269 | 5 | 80715081 | 84252180 |
| 7270 | 5 | 80715081 | 84253030 |
| 7271 | 5 | 80715081 | 84254208 |
| 7272 | 5 | 80715081 | 84314930 |
| 7273 | 5 | 80715081 | 84340523 |
| 7274 | 5 | 80715081 | 84516340 |
| 7275 | 5 | 80715081 | 84706916 |
| 7276 | 5 | 80715081 | 84799488 |
| 7277 | 5 | 80715081 | 84801081 |
| 7278 | 5 | 80715081 | 84824103 |
| 7279 | 5 | 80715081 | 84824203 |
| 7280 | 5 | 80715081 | 84824816 |
| 7281 | 5 | 80715081 | 84825422 |
| 7282 | 5 | 80715081 | 84825763 |
| 7283 | 5 | 80715081 | 84825942 |
| 7284 | 5 | 80715081 | 84843411 |
| 7285 | 5 | 80715081 | 84936441 |
| 7286 | 5 | 80715081 | 84936493 |
| 7287 | 5 | 80715081 | 84943705 |
| 7288 | 5 | 80715081 | 169454950 |
| 7289 | 5 | 80715081 | 181522829 |
| 7290 | 5 | 80715081 | 204759879 |
| 7291 | 5 | 80715081 | 209874191 |
| 7292 | 5 | 80795990 | 80800856 |
| 7293 | 5 | 80795990 | 80804587 |
| 7294 | 5 | 80795990 | 80807409 |
| 7295 | 5 | 80795990 | 80835734 |
| 7296 | 5 | 80795990 | 80971764 |
| 7297 | 5 | 80795990 | 80972258 |
| 7298 | 5 | 80795990 | 80974450 |
| 7299 | 5 | 80795990 | 81047638 |
| 7300 | 5 | 80795990 | 81082921 |
| 7301 | 5 | 80795990 | 81157909 |
| 7302 | 5 | 80795990 | 81265937 |

TABLE 1-continued

Examples of chromosomal segments associated with increased fertility in maize.

| Chromosomal Segment | Chr. | Boundary 1 | Boundary 2 |
| --- | --- | --- | --- |
| 7303 | 5 | 80795990 | 81265937 |
| 7304 | 5 | 80795990 | 81267485 |
| 7305 | 5 | 80795990 | 81267499 |
| 7306 | 5 | 80795990 | 81274512 |
| 7307 | 5 | 80795990 | 81763618 |
| 7308 | 5 | 80795990 | 81797217 |
| 7309 | 5 | 80795990 | 81800186 |
| 7310 | 5 | 80795990 | 81806213 |
| 7311 | 5 | 80795990 | 81854583 |
| 7312 | 5 | 80795990 | 81859374 |
| 7313 | 5 | 80795990 | 81861368 |
| 7314 | 5 | 80795990 | 81863686 |
| 7315 | 5 | 80795990 | 81916850 |
| 7316 | 5 | 80795990 | 81954891 |
| 7317 | 5 | 80795990 | 81985250 |
| 7318 | 5 | 80795990 | 82083752 |
| 7319 | 5 | 80795990 | 82101253 |
| 7320 | 5 | 80795990 | 82143124 |
| 7321 | 5 | 80795990 | 82236318 |
| 7322 | 5 | 80795990 | 82325587 |
| 7323 | 5 | 80795990 | 82427210 |
| 7324 | 5 | 80795990 | 82431853 |
| 7325 | 5 | 80795990 | 82446714 |
| 7326 | 5 | 80795990 | 82446794 |
| 7327 | 5 | 80795990 | 82551111 |
| 7328 | 5 | 80795990 | 82552090 |
| 7329 | 5 | 80795990 | 82555641 |
| 7330 | 5 | 80795990 | 82555670 |
| 7331 | 5 | 80795990 | 82556511 |
| 7332 | 5 | 80795990 | 82559047 |
| 7333 | 5 | 80795990 | 82561535 |
| 7334 | 5 | 80795990 | 82610100 |
| 7335 | 5 | 80795990 | 82676822 |
| 7336 | 5 | 80795990 | 82676901 |
| 7337 | 5 | 80795990 | 82883691 |
| 7338 | 5 | 80795990 | 82954942 |
| 7339 | 5 | 80795990 | 82971688 |
| 7340 | 5 | 80795990 | 83023965 |
| 7341 | 5 | 80795990 | 83094205 |
| 7342 | 5 | 80795990 | 83146355 |
| 7343 | 5 | 80795990 | 83280630 |
| 7344 | 5 | 80795990 | 83281412 |
| 7345 | 5 | 80795990 | 83400242 |
| 7346 | 5 | 80795990 | 83405797 |
| 7347 | 5 | 80795990 | 83437132 |
| 7348 | 5 | 80795990 | 83522252 |
| 7349 | 5 | 80795990 | 83560095 |
| 7350 | 5 | 80795990 | 83560204 |
| 7351 | 5 | 80795990 | 83572400 |
| 7352 | 5 | 80795990 | 83607661 |
| 7353 | 5 | 80795990 | 83745342 |
| 7354 | 5 | 80795990 | 83861275 |
| 7355 | 5 | 80795990 | 83861633 |
| 7356 | 5 | 80795990 | 83865653 |
| 7357 | 5 | 80795990 | 83865914 |
| 7358 | 5 | 80795990 | 83865920 |
| 7359 | 5 | 80795990 | 83868010 |
| 7360 | 5 | 80795990 | 84019752 |
| 7361 | 5 | 80795990 | 84065912 |
| 7362 | 5 | 80795990 | 84086632 |
| 7363 | 5 | 80795990 | 84089603 |
| 7364 | 5 | 80795990 | 84104814 |
| 7365 | 5 | 80795990 | 84105175 |
| 7366 | 5 | 80795990 | 84251635 |
| 7367 | 5 | 80795990 | 84252180 |
| 7368 | 5 | 80795990 | 84253030 |
| 7369 | 5 | 80795990 | 84254208 |
| 7370 | 5 | 80795990 | 84314930 |
| 7371 | 5 | 80795990 | 84340523 |
| 7372 | 5 | 80795990 | 84516340 |
| 7373 | 5 | 80795990 | 84706916 |
| 7374 | 5 | 80795990 | 84799488 |
| 7375 | 5 | 80795990 | 84801081 |
| 7376 | 5 | 80795990 | 84824103 |
| 7377 | 5 | 80795990 | 84824203 |
| 7378 | 5 | 80795990 | 84824816 |
| 7379 | 5 | 80795990 | 84825422 |
| 7380 | 5 | 80795990 | 84825763 |
| 7381 | 5 | 80795990 | 84825942 |
| 7382 | 5 | 80795990 | 84843411 |
| 7383 | 5 | 80795990 | 84936441 |
| 7384 | 5 | 80795990 | 84936493 |
| 7385 | 5 | 80795990 | 84943705 |
| 7386 | 5 | 80795990 | 169454950 |
| 7387 | 5 | 80795990 | 181522829 |
| 7388 | 5 | 80795990 | 204759879 |
| 7389 | 5 | 80795990 | 209874191 |
| 7390 | 5 | 80803727 | 80804587 |
| 7391 | 5 | 80803727 | 80807409 |
| 7392 | 5 | 80803727 | 80835734 |
| 7393 | 5 | 80803727 | 80971764 |
| 7394 | 5 | 80803727 | 80972258 |
| 7395 | 5 | 80803727 | 80974450 |
| 7396 | 5 | 80803727 | 81047638 |
| 7397 | 5 | 80803727 | 81082921 |
| 7398 | 5 | 80803727 | 81157909 |
| 7399 | 5 | 80803727 | 81265937 |
| 7400 | 5 | 80803727 | 81265937 |
| 7401 | 5 | 80803727 | 81267485 |
| 7402 | 5 | 80803727 | 81267499 |
| 7403 | 5 | 80803727 | 81274512 |
| 7404 | 5 | 80803727 | 81763618 |
| 7405 | 5 | 80803727 | 81797217 |
| 7406 | 5 | 80803727 | 81800186 |
| 7407 | 5 | 80803727 | 81806213 |
| 7408 | 5 | 80803727 | 81854583 |
| 7409 | 5 | 80803727 | 81859374 |
| 7410 | 5 | 80803727 | 81861368 |
| 7411 | 5 | 80803727 | 81863686 |
| 7412 | 5 | 80803727 | 81916850 |
| 7413 | 5 | 80803727 | 81954891 |
| 7414 | 5 | 80803727 | 81985250 |
| 7415 | 5 | 80803727 | 82083752 |
| 7416 | 5 | 80803727 | 82101253 |
| 7417 | 5 | 80803727 | 82143124 |
| 7418 | 5 | 80803727 | 82236318 |
| 7419 | 5 | 80803727 | 82325587 |
| 7420 | 5 | 80803727 | 82427210 |
| 7421 | 5 | 80803727 | 82431853 |
| 7422 | 5 | 80803727 | 82446714 |
| 7423 | 5 | 80803727 | 82446794 |
| 7424 | 5 | 80803727 | 82551111 |
| 7425 | 5 | 80803727 | 82552090 |
| 7426 | 5 | 80803727 | 82555641 |
| 7427 | 5 | 80803727 | 82555670 |
| 7428 | 5 | 80803727 | 82556511 |
| 7429 | 5 | 80803727 | 82559047 |
| 7430 | 5 | 80803727 | 82561535 |
| 7431 | 5 | 80803727 | 82610100 |
| 7432 | 5 | 80803727 | 82676822 |
| 7433 | 5 | 80803727 | 82676901 |
| 7434 | 5 | 80803727 | 82883691 |
| 7435 | 5 | 80803727 | 82954942 |
| 7436 | 5 | 80803727 | 82971688 |
| 7437 | 5 | 80803727 | 83023965 |
| 7438 | 5 | 80803727 | 83094205 |
| 7439 | 5 | 80803727 | 83146355 |
| 7440 | 5 | 80803727 | 83280630 |
| 7441 | 5 | 80803727 | 83281412 |
| 7442 | 5 | 80803727 | 83400242 |
| 7443 | 5 | 80803727 | 83405797 |
| 7444 | 5 | 80803727 | 83437132 |
| 7445 | 5 | 80803727 | 83522252 |
| 7446 | 5 | 80803727 | 83560095 |
| 7447 | 5 | 80803727 | 83560204 |
| 7448 | 5 | 80803727 | 83572400 |
| 7449 | 5 | 80803727 | 83607661 |
| 7450 | 5 | 80803727 | 83745342 |

TABLE 1-continued

Examples of chromosomal segments associated with increased fertility in maize.

| Chromosomal Segment | Chr. | Boundary 1 | Boundary 2 |
|---|---|---|---|
| 7451 | 5 | 80803727 | 83861275 |
| 7452 | 5 | 80803727 | 83861633 |
| 7453 | 5 | 80803727 | 83865653 |
| 7454 | 5 | 80803727 | 83865914 |
| 7455 | 5 | 80803727 | 83865920 |
| 7456 | 5 | 80803727 | 83868010 |
| 7457 | 5 | 80803727 | 84019752 |
| 7458 | 5 | 80803727 | 84065912 |
| 7459 | 5 | 80803727 | 84086632 |
| 7460 | 5 | 80803727 | 84089603 |
| 7461 | 5 | 80803727 | 84104814 |
| 7462 | 5 | 80803727 | 84105175 |
| 7463 | 5 | 80803727 | 84251635 |
| 7464 | 5 | 80803727 | 84252180 |
| 7465 | 5 | 80803727 | 84253030 |
| 7466 | 5 | 80803727 | 84254208 |
| 7467 | 5 | 80803727 | 84314930 |
| 7468 | 5 | 80803727 | 84340523 |
| 7469 | 5 | 80803727 | 84516340 |
| 7470 | 5 | 80803727 | 84706916 |
| 7471 | 5 | 80803727 | 84799488 |
| 7472 | 5 | 80803727 | 84801081 |
| 7473 | 5 | 80803727 | 84824103 |
| 7474 | 5 | 80803727 | 84824203 |
| 7475 | 5 | 80803727 | 84824816 |
| 7476 | 5 | 80803727 | 84825422 |
| 7477 | 5 | 80803727 | 84825763 |
| 7478 | 5 | 80803727 | 84825942 |
| 7479 | 5 | 80803727 | 84843411 |
| 7480 | 5 | 80803727 | 84936441 |
| 7481 | 5 | 80803727 | 84936493 |
| 7482 | 5 | 80803727 | 84943705 |
| 7483 | 5 | 80803727 | 169454950 |
| 7484 | 5 | 80803727 | 181522829 |
| 7485 | 5 | 80803727 | 204759879 |
| 7486 | 5 | 80803727 | 209874191 |
| 7487 | 5 | 80804587 | 80835734 |
| 7488 | 5 | 80804587 | 80971764 |
| 7489 | 5 | 80804587 | 80972258 |
| 7490 | 5 | 80804587 | 80974450 |
| 7491 | 5 | 80804587 | 81047638 |
| 7492 | 5 | 80804587 | 81082921 |
| 7493 | 5 | 80804587 | 81157909 |
| 7494 | 5 | 80804587 | 81265937 |
| 7495 | 5 | 80804587 | 81265937 |
| 7496 | 5 | 80804587 | 81267485 |
| 7497 | 5 | 80804587 | 81267499 |
| 7498 | 5 | 80804587 | 81274512 |
| 7499 | 5 | 80804587 | 81763618 |
| 7500 | 5 | 80804587 | 81797217 |
| 7501 | 5 | 80804587 | 81800186 |
| 7502 | 5 | 80804587 | 81806213 |
| 7503 | 5 | 80804587 | 81854583 |
| 7504 | 5 | 80804587 | 81859374 |
| 7505 | 5 | 80804587 | 81861368 |
| 7506 | 5 | 80804587 | 81863686 |
| 7507 | 5 | 80804587 | 81916850 |
| 7508 | 5 | 80804587 | 81954891 |
| 7509 | 5 | 80804587 | 81985250 |
| 7510 | 5 | 80804587 | 82083752 |
| 7511 | 5 | 80804587 | 82101253 |
| 7512 | 5 | 80804587 | 82143124 |
| 7513 | 5 | 80804587 | 82236318 |
| 7514 | 5 | 80804587 | 82325587 |
| 7515 | 5 | 80804587 | 82427210 |
| 7516 | 5 | 80804587 | 82431853 |
| 7517 | 5 | 80804587 | 82446714 |
| 7518 | 5 | 80804587 | 82446794 |
| 7519 | 5 | 80804587 | 82551111 |
| 7520 | 5 | 80804587 | 82552090 |
| 7521 | 5 | 80804587 | 82555641 |
| 7522 | 5 | 80804587 | 82555670 |
| 7523 | 5 | 80804587 | 82556511 |
| 7524 | 5 | 80804587 | 82559047 |
| 7525 | 5 | 80804587 | 82561535 |
| 7526 | 5 | 80804587 | 82610100 |
| 7527 | 5 | 80804587 | 82676822 |
| 7528 | 5 | 80804587 | 82676901 |
| 7529 | 5 | 80804587 | 82883691 |
| 7530 | 5 | 80804587 | 82954942 |
| 7531 | 5 | 80804587 | 82971688 |
| 7532 | 5 | 80804587 | 83023965 |
| 7533 | 5 | 80804587 | 83094205 |
| 7534 | 5 | 80804587 | 83146355 |
| 7535 | 5 | 80804587 | 83280630 |
| 7536 | 5 | 80804587 | 83281412 |
| 7537 | 5 | 80804587 | 83400242 |
| 7538 | 5 | 80804587 | 83405797 |
| 7539 | 5 | 80804587 | 83437132 |
| 7540 | 5 | 80804587 | 83522252 |
| 7541 | 5 | 80804587 | 83560095 |
| 7542 | 5 | 80804587 | 83560204 |
| 7543 | 5 | 80804587 | 83572400 |
| 7544 | 5 | 80804587 | 83607661 |
| 7545 | 5 | 80804587 | 83745342 |
| 7546 | 5 | 80804587 | 83861275 |
| 7547 | 5 | 80804587 | 83861633 |
| 7548 | 5 | 80804587 | 83865653 |
| 7549 | 5 | 80804587 | 83865914 |
| 7550 | 5 | 80804587 | 83865920 |
| 7551 | 5 | 80804587 | 83868010 |
| 7552 | 5 | 80804587 | 84019752 |
| 7553 | 5 | 80804587 | 84065912 |
| 7554 | 5 | 80804587 | 84086632 |
| 7555 | 5 | 80804587 | 84089603 |
| 7556 | 5 | 80804587 | 84104814 |
| 7557 | 5 | 80804587 | 84105175 |
| 7558 | 5 | 80804587 | 84251635 |
| 7559 | 5 | 80804587 | 84252180 |
| 7560 | 5 | 80804587 | 84253030 |
| 7561 | 5 | 80804587 | 84254208 |
| 7562 | 5 | 80804587 | 84314930 |
| 7563 | 5 | 80804587 | 84340523 |
| 7564 | 5 | 80804587 | 84516340 |
| 7565 | 5 | 80804587 | 84706916 |
| 7566 | 5 | 80804587 | 84799488 |
| 7567 | 5 | 80804587 | 84801081 |
| 7568 | 5 | 80804587 | 84824103 |
| 7569 | 5 | 80804587 | 84824203 |
| 7570 | 5 | 80804587 | 84824816 |
| 7571 | 5 | 80804587 | 84825422 |
| 7572 | 5 | 80804587 | 84825763 |
| 7573 | 5 | 80804587 | 84825942 |
| 7574 | 5 | 80804587 | 84843411 |
| 7575 | 5 | 80804587 | 84936441 |
| 7576 | 5 | 80804587 | 84936493 |
| 7577 | 5 | 80804587 | 84943705 |
| 7578 | 5 | 80804587 | 169454950 |
| 7579 | 5 | 80804587 | 181522829 |
| 7580 | 5 | 80804587 | 204759879 |
| 7581 | 5 | 80804587 | 209874191 |
| 7582 | 5 | 80828457 | 80835734 |
| 7583 | 5 | 80828457 | 80971764 |
| 7584 | 5 | 80828457 | 80972258 |
| 7585 | 5 | 80828457 | 80974450 |
| 7586 | 5 | 80828457 | 81047638 |
| 7587 | 5 | 80828457 | 81082921 |
| 7588 | 5 | 80828457 | 81157909 |
| 7589 | 5 | 80828457 | 81265937 |
| 7590 | 5 | 80828457 | 81265937 |
| 7591 | 5 | 80828457 | 81267485 |
| 7592 | 5 | 80828457 | 81267499 |
| 7593 | 5 | 80828457 | 81274512 |
| 7594 | 5 | 80828457 | 81763618 |
| 7595 | 5 | 80828457 | 81797217 |
| 7596 | 5 | 80828457 | 81800186 |
| 7597 | 5 | 80828457 | 81806213 |
| 7598 | 5 | 80828457 | 81854583 |

TABLE 1-continued

Examples of chromosomal segments associated with increased fertility in maize.

| Chromosomal Segment | Chr. | Boundary 1 | Boundary 2 |
|---|---|---|---|
| 7599 | 5 | 80828457 | 81859374 |
| 7600 | 5 | 80828457 | 81861368 |
| 7601 | 5 | 80828457 | 81863686 |
| 7602 | 5 | 80828457 | 81916850 |
| 7603 | 5 | 80828457 | 81954891 |
| 7604 | 5 | 80828457 | 81985250 |
| 7605 | 5 | 80828457 | 82083752 |
| 7606 | 5 | 80828457 | 82101253 |
| 7607 | 5 | 80828457 | 82143124 |
| 7608 | 5 | 80828457 | 82236318 |
| 7609 | 5 | 80828457 | 82325587 |
| 7610 | 5 | 80828457 | 82427210 |
| 7611 | 5 | 80828457 | 82431853 |
| 7612 | 5 | 80828457 | 82446714 |
| 7613 | 5 | 80828457 | 82446794 |
| 7614 | 5 | 80828457 | 82551111 |
| 7615 | 5 | 80828457 | 82552090 |
| 7616 | 5 | 80828457 | 82555641 |
| 7617 | 5 | 80828457 | 82555670 |
| 7618 | 5 | 80828457 | 82556511 |
| 7619 | 5 | 80828457 | 82559047 |
| 7620 | 5 | 80828457 | 82561535 |
| 7621 | 5 | 80828457 | 82610100 |
| 7622 | 5 | 80828457 | 82676822 |
| 7623 | 5 | 80828457 | 82676901 |
| 7624 | 5 | 80828457 | 82883691 |
| 7625 | 5 | 80828457 | 82954942 |
| 7626 | 5 | 80828457 | 82971688 |
| 7627 | 5 | 80828457 | 83023965 |
| 7628 | 5 | 80828457 | 83094205 |
| 7629 | 5 | 80828457 | 83146355 |
| 7630 | 5 | 80828457 | 83280630 |
| 7631 | 5 | 80828457 | 83281412 |
| 7632 | 5 | 80828457 | 83400242 |
| 7633 | 5 | 80828457 | 83405797 |
| 7634 | 5 | 80828457 | 83437132 |
| 7635 | 5 | 80828457 | 83522252 |
| 7636 | 5 | 80828457 | 83560095 |
| 7637 | 5 | 80828457 | 83560204 |
| 7638 | 5 | 80828457 | 83572400 |
| 7639 | 5 | 80828457 | 83607661 |
| 7640 | 5 | 80828457 | 83745342 |
| 7641 | 5 | 80828457 | 83861275 |
| 7642 | 5 | 80828457 | 83861633 |
| 7643 | 5 | 80828457 | 83865653 |
| 7644 | 5 | 80828457 | 83865914 |
| 7645 | 5 | 80828457 | 83865920 |
| 7646 | 5 | 80828457 | 83868010 |
| 7647 | 5 | 80828457 | 84019752 |
| 7648 | 5 | 80828457 | 84065912 |
| 7649 | 5 | 80828457 | 84086632 |
| 7650 | 5 | 80828457 | 84089603 |
| 7651 | 5 | 80828457 | 84104814 |
| 7652 | 5 | 80828457 | 84105175 |
| 7653 | 5 | 80828457 | 84251635 |
| 7654 | 5 | 80828457 | 84252180 |
| 7655 | 5 | 80828457 | 84253030 |
| 7656 | 5 | 80828457 | 84254208 |
| 7657 | 5 | 80828457 | 84314930 |
| 7658 | 5 | 80828457 | 84340523 |
| 7659 | 5 | 80828457 | 84516340 |
| 7660 | 5 | 80828457 | 84706916 |
| 7661 | 5 | 80828457 | 84799488 |
| 7662 | 5 | 80828457 | 84801081 |
| 7663 | 5 | 80828457 | 84824103 |
| 7664 | 5 | 80828457 | 84824203 |
| 7665 | 5 | 80828457 | 84824816 |
| 7666 | 5 | 80828457 | 84825422 |
| 7667 | 5 | 80828457 | 84825763 |
| 7668 | 5 | 80828457 | 84825942 |
| 7669 | 5 | 80828457 | 84843411 |
| 7670 | 5 | 80828457 | 84936441 |
| 7671 | 5 | 80828457 | 84936493 |
| 7672 | 5 | 80828457 | 84943705 |
| 7673 | 5 | 80828457 | 169454950 |
| 7674 | 5 | 80828457 | 181522829 |
| 7675 | 5 | 80828457 | 204759879 |
| 7676 | 5 | 80828457 | 209874191 |
| 7677 | 5 | 80828945 | 80835734 |
| 7678 | 5 | 80828945 | 80971764 |
| 7679 | 5 | 80828945 | 80972258 |
| 7680 | 5 | 80828945 | 80974450 |
| 7681 | 5 | 80828945 | 81047638 |
| 7682 | 5 | 80828945 | 81082921 |
| 7683 | 5 | 80828945 | 81157909 |
| 7684 | 5 | 80828945 | 81265937 |
| 7685 | 5 | 80828945 | 81265937 |
| 7686 | 5 | 80828945 | 81267485 |
| 7687 | 5 | 80828945 | 81267499 |
| 7688 | 5 | 80828945 | 81274512 |
| 7689 | 5 | 80828945 | 81763618 |
| 7690 | 5 | 80828945 | 81797217 |
| 7691 | 5 | 80828945 | 81800186 |
| 7692 | 5 | 80828945 | 81806213 |
| 7693 | 5 | 80828945 | 81854583 |
| 7694 | 5 | 80828945 | 81859374 |
| 7695 | 5 | 80828945 | 81861368 |
| 7696 | 5 | 80828945 | 81863686 |
| 7697 | 5 | 80828945 | 81916850 |
| 7698 | 5 | 80828945 | 81954891 |
| 7699 | 5 | 80828945 | 81985250 |
| 7700 | 5 | 80828945 | 82083752 |
| 7701 | 5 | 80828945 | 82101253 |
| 7702 | 5 | 80828945 | 82143124 |
| 7703 | 5 | 80828945 | 82236318 |
| 7704 | 5 | 80828945 | 82325587 |
| 7705 | 5 | 80828945 | 82427210 |
| 7706 | 5 | 80828945 | 82431853 |
| 7707 | 5 | 80828945 | 82446714 |
| 7708 | 5 | 80828945 | 82446794 |
| 7709 | 5 | 80828945 | 82551111 |
| 7710 | 5 | 80828945 | 82552090 |
| 7711 | 5 | 80828945 | 82555641 |
| 7712 | 5 | 80828945 | 82555670 |
| 7713 | 5 | 80828945 | 82556511 |
| 7714 | 5 | 80828945 | 82559047 |
| 7715 | 5 | 80828945 | 82561535 |
| 7716 | 5 | 80828945 | 82610100 |
| 7717 | 5 | 80828945 | 82676822 |
| 7718 | 5 | 80828945 | 82676901 |
| 7719 | 5 | 80828945 | 82883691 |
| 7720 | 5 | 80828945 | 82954942 |
| 7721 | 5 | 80828945 | 82971688 |
| 7722 | 5 | 80828945 | 83023965 |
| 7723 | 5 | 80828945 | 83094205 |
| 7724 | 5 | 80828945 | 83146355 |
| 7725 | 5 | 80828945 | 83280630 |
| 7726 | 5 | 80828945 | 83281412 |
| 7727 | 5 | 80828945 | 83400242 |
| 7728 | 5 | 80828945 | 83405797 |
| 7729 | 5 | 80828945 | 83437132 |
| 7730 | 5 | 80828945 | 83522252 |
| 7731 | 5 | 80828945 | 83560095 |
| 7732 | 5 | 80828945 | 83560204 |
| 7733 | 5 | 80828945 | 83572400 |
| 7734 | 5 | 80828945 | 83607661 |
| 7735 | 5 | 80828945 | 83745342 |
| 7736 | 5 | 80828945 | 83861275 |
| 7737 | 5 | 80828945 | 83861633 |
| 7738 | 5 | 80828945 | 83865653 |
| 7739 | 5 | 80828945 | 83865914 |
| 7740 | 5 | 80828945 | 83865920 |
| 7741 | 5 | 80828945 | 83868010 |
| 7742 | 5 | 80828945 | 84019752 |
| 7743 | 5 | 80828945 | 84065912 |
| 7744 | 5 | 80828945 | 84086632 |
| 7745 | 5 | 80828945 | 84089603 |
| 7746 | 5 | 80828945 | 84104814 |

TABLE 1-continued

Examples of chromosomal segments associated with increased fertility in maize.

| Chromosomal Segment | Chr. | Boundary 1 | Boundary 2 |
| --- | --- | --- | --- |
| 7747 | 5 | 80828945 | 84105175 |
| 7748 | 5 | 80828945 | 84251635 |
| 7749 | 5 | 80828945 | 84252180 |
| 7750 | 5 | 80828945 | 84253030 |
| 7751 | 5 | 80828945 | 84254208 |
| 7752 | 5 | 80828945 | 84314930 |
| 7753 | 5 | 80828945 | 84340523 |
| 7754 | 5 | 80828945 | 84516340 |
| 7755 | 5 | 80828945 | 84706916 |
| 7756 | 5 | 80828945 | 84799488 |
| 7757 | 5 | 80828945 | 84801081 |
| 7758 | 5 | 80828945 | 84824103 |
| 7759 | 5 | 80828945 | 84824203 |
| 7760 | 5 | 80828945 | 84824816 |
| 7761 | 5 | 80828945 | 84825422 |
| 7762 | 5 | 80828945 | 84825763 |
| 7763 | 5 | 80828945 | 84825942 |
| 7764 | 5 | 80828945 | 84843411 |
| 7765 | 5 | 80828945 | 84936441 |
| 7766 | 5 | 80828945 | 84936493 |
| 7767 | 5 | 80828945 | 84943705 |
| 7768 | 5 | 80828945 | 169454950 |
| 7769 | 5 | 80828945 | 181522829 |
| 7770 | 5 | 80828945 | 204759879 |
| 7771 | 5 | 80828945 | 209874191 |
| 7772 | 5 | 80969412 | 80971764 |
| 7773 | 5 | 80969412 | 80972258 |
| 7774 | 5 | 80969412 | 80974450 |
| 7775 | 5 | 80969412 | 81047638 |
| 7776 | 5 | 80969412 | 81082921 |
| 7777 | 5 | 80969412 | 81157909 |
| 7778 | 5 | 80969412 | 81265937 |
| 7779 | 5 | 80969412 | 81265937 |
| 7780 | 5 | 80969412 | 81267485 |
| 7781 | 5 | 80969412 | 81267499 |
| 7782 | 5 | 80969412 | 81274512 |
| 7783 | 5 | 80969412 | 81763618 |
| 7784 | 5 | 80969412 | 81797217 |
| 7785 | 5 | 80969412 | 81800186 |
| 7786 | 5 | 80969412 | 81806213 |
| 7787 | 5 | 80969412 | 81854583 |
| 7788 | 5 | 80969412 | 81859374 |
| 7789 | 5 | 80969412 | 81861368 |
| 7790 | 5 | 80969412 | 81863686 |
| 7791 | 5 | 80969412 | 81916850 |
| 7792 | 5 | 80969412 | 81954891 |
| 7793 | 5 | 80969412 | 81985250 |
| 7794 | 5 | 80969412 | 82083752 |
| 7795 | 5 | 80969412 | 82101253 |
| 7796 | 5 | 80969412 | 82143124 |
| 7797 | 5 | 80969412 | 82236318 |
| 7798 | 5 | 80969412 | 82325587 |
| 7799 | 5 | 80969412 | 82427210 |
| 7800 | 5 | 80969412 | 82431853 |
| 7801 | 5 | 80969412 | 82446714 |
| 7802 | 5 | 80969412 | 82446794 |
| 7803 | 5 | 80969412 | 82551111 |
| 7804 | 5 | 80969412 | 82552090 |
| 7805 | 5 | 80969412 | 82555641 |
| 7806 | 5 | 80969412 | 82555670 |
| 7807 | 5 | 80969412 | 82556511 |
| 7808 | 5 | 80969412 | 82559047 |
| 7809 | 5 | 80969412 | 82561535 |
| 7810 | 5 | 80969412 | 82610100 |
| 7811 | 5 | 80969412 | 82676822 |
| 7812 | 5 | 80969412 | 82676901 |
| 7813 | 5 | 80969412 | 82883691 |
| 7814 | 5 | 80969412 | 82954942 |
| 7815 | 5 | 80969412 | 82971688 |
| 7816 | 5 | 80969412 | 83023965 |
| 7817 | 5 | 80969412 | 83094205 |
| 7818 | 5 | 80969412 | 83146355 |
| 7819 | 5 | 80969412 | 83280630 |
| 7820 | 5 | 80969412 | 83281412 |
| 7821 | 5 | 80969412 | 83400242 |
| 7822 | 5 | 80969412 | 83405797 |
| 7823 | 5 | 80969412 | 83437132 |
| 7824 | 5 | 80969412 | 83522252 |
| 7825 | 5 | 80969412 | 83560095 |
| 7826 | 5 | 80969412 | 83560204 |
| 7827 | 5 | 80969412 | 83572400 |
| 7828 | 5 | 80969412 | 83607661 |
| 7829 | 5 | 80969412 | 83745342 |
| 7830 | 5 | 80969412 | 83861275 |
| 7831 | 5 | 80969412 | 83861633 |
| 7832 | 5 | 80969412 | 83865653 |
| 7833 | 5 | 80969412 | 83865914 |
| 7834 | 5 | 80969412 | 83865920 |
| 7835 | 5 | 80969412 | 83868010 |
| 7836 | 5 | 80969412 | 84019752 |
| 7837 | 5 | 80969412 | 84065912 |
| 7838 | 5 | 80969412 | 84086632 |
| 7839 | 5 | 80969412 | 84089603 |
| 7840 | 5 | 80969412 | 84104814 |
| 7841 | 5 | 80969412 | 84105175 |
| 7842 | 5 | 80969412 | 84251635 |
| 7843 | 5 | 80969412 | 84252180 |
| 7844 | 5 | 80969412 | 84253030 |
| 7845 | 5 | 80969412 | 84254208 |
| 7846 | 5 | 80969412 | 84314930 |
| 7847 | 5 | 80969412 | 84340523 |
| 7848 | 5 | 80969412 | 84516340 |
| 7849 | 5 | 80969412 | 84706916 |
| 7850 | 5 | 80969412 | 84799488 |
| 7851 | 5 | 80969412 | 84801081 |
| 7852 | 5 | 80969412 | 84824103 |
| 7853 | 5 | 80969412 | 84824203 |
| 7854 | 5 | 80969412 | 84824816 |
| 7855 | 5 | 80969412 | 84825422 |
| 7856 | 5 | 80969412 | 84825763 |
| 7857 | 5 | 80969412 | 84825942 |
| 7858 | 5 | 80969412 | 84843411 |
| 7859 | 5 | 80969412 | 84936441 |
| 7860 | 5 | 80969412 | 84936493 |
| 7861 | 5 | 80969412 | 84943705 |
| 7862 | 5 | 80969412 | 169454950 |
| 7863 | 5 | 80969412 | 181522829 |
| 7864 | 5 | 80969412 | 204759879 |
| 7865 | 5 | 80969412 | 209874191 |
| 7866 | 5 | 80970381 | 80974450 |
| 7867 | 5 | 80970381 | 81047638 |
| 7868 | 5 | 80970381 | 81082921 |
| 7869 | 5 | 80970381 | 81157909 |
| 7870 | 5 | 80970381 | 81265937 |
| 7871 | 5 | 80970381 | 81265937 |
| 7872 | 5 | 80970381 | 81267485 |
| 7873 | 5 | 80970381 | 81267499 |
| 7874 | 5 | 80970381 | 81274512 |
| 7875 | 5 | 80970381 | 81763618 |
| 7876 | 5 | 80970381 | 81797217 |
| 7877 | 5 | 80970381 | 81800186 |
| 7878 | 5 | 80970381 | 81806213 |
| 7879 | 5 | 80970381 | 81854583 |
| 7880 | 5 | 80970381 | 81859374 |
| 7881 | 5 | 80970381 | 81861368 |
| 7882 | 5 | 80970381 | 81863686 |
| 7883 | 5 | 80970381 | 81916850 |
| 7884 | 5 | 80970381 | 81954891 |
| 7885 | 5 | 80970381 | 81985250 |
| 7886 | 5 | 80970381 | 82083752 |
| 7887 | 5 | 80970381 | 82101253 |
| 7888 | 5 | 80970381 | 82143124 |
| 7889 | 5 | 80970381 | 82236318 |
| 7890 | 5 | 80970381 | 82325587 |
| 7891 | 5 | 80970381 | 82427210 |
| 7892 | 5 | 80970381 | 82431853 |
| 7893 | 5 | 80970381 | 82446714 |
| 7894 | 5 | 80970381 | 82446794 |

TABLE 1-continued

Examples of chromosomal segments associated with increased fertility in maize.

| Chromosomal Segment | Chr. | Boundary 1 | Boundary 2 |
|---|---|---|---|
| 7895 | 5 | 80970381 | 82551111 |
| 7896 | 5 | 80970381 | 82552090 |
| 7897 | 5 | 80970381 | 82555641 |
| 7898 | 5 | 80970381 | 82555670 |
| 7899 | 5 | 80970381 | 82556511 |
| 7900 | 5 | 80970381 | 82559047 |
| 7901 | 5 | 80970381 | 82561535 |
| 7902 | 5 | 80970381 | 82610100 |
| 7903 | 5 | 80970381 | 82676822 |
| 7904 | 5 | 80970381 | 82676901 |
| 7905 | 5 | 80970381 | 82883691 |
| 7906 | 5 | 80970381 | 82954942 |
| 7907 | 5 | 80970381 | 82971688 |
| 7908 | 5 | 80970381 | 83023965 |
| 7909 | 5 | 80970381 | 83094205 |
| 7910 | 5 | 80970381 | 83146355 |
| 7911 | 5 | 80970381 | 83280630 |
| 7912 | 5 | 80970381 | 83281412 |
| 7913 | 5 | 80970381 | 83400242 |
| 7914 | 5 | 80970381 | 83405797 |
| 7915 | 5 | 80970381 | 83437132 |
| 7916 | 5 | 80970381 | 83522252 |
| 7917 | 5 | 80970381 | 83560095 |
| 7918 | 5 | 80970381 | 83560204 |
| 7919 | 5 | 80970381 | 83572400 |
| 7920 | 5 | 80970381 | 83607661 |
| 7921 | 5 | 80970381 | 83745342 |
| 7922 | 5 | 80970381 | 83861275 |
| 7923 | 5 | 80970381 | 83861633 |
| 7924 | 5 | 80970381 | 83865653 |
| 7925 | 5 | 80970381 | 83865914 |
| 7926 | 5 | 80970381 | 83865920 |
| 7927 | 5 | 80970381 | 83868010 |
| 7928 | 5 | 80970381 | 84019752 |
| 7929 | 5 | 80970381 | 84065912 |
| 7930 | 5 | 80970381 | 84086632 |
| 7931 | 5 | 80970381 | 84089603 |
| 7932 | 5 | 80970381 | 84104814 |
| 7933 | 5 | 80970381 | 84105175 |
| 7934 | 5 | 80970381 | 84251635 |
| 7935 | 5 | 80970381 | 84252180 |
| 7936 | 5 | 80970381 | 84253030 |
| 7937 | 5 | 80970381 | 84254208 |
| 7938 | 5 | 80970381 | 84314930 |
| 7939 | 5 | 80970381 | 84340523 |
| 7940 | 5 | 80970381 | 84516340 |
| 7941 | 5 | 80970381 | 84706916 |
| 7942 | 5 | 80970381 | 84799488 |
| 7943 | 5 | 80970381 | 84801081 |
| 7944 | 5 | 80970381 | 84824103 |
| 7945 | 5 | 80970381 | 84824203 |
| 7946 | 5 | 80970381 | 84824816 |
| 7947 | 5 | 80970381 | 84825422 |
| 7948 | 5 | 80970381 | 84825763 |
| 7949 | 5 | 80970381 | 84825942 |
| 7950 | 5 | 80970381 | 84843411 |
| 7951 | 5 | 80970381 | 84936441 |
| 7952 | 5 | 80970381 | 84936493 |
| 7953 | 5 | 80970381 | 84943705 |
| 7954 | 5 | 80970381 | 169454950 |
| 7955 | 5 | 80970381 | 181522829 |
| 7956 | 5 | 80970381 | 204759879 |
| 7957 | 5 | 80970381 | 209874191 |
| 7958 | 5 | 80971764 | 81047638 |
| 7959 | 5 | 80971764 | 81082921 |
| 7960 | 5 | 80971764 | 81157909 |
| 7961 | 5 | 80971764 | 81265937 |
| 7962 | 5 | 80971764 | 81265937 |
| 7963 | 5 | 80971764 | 81267485 |
| 7964 | 5 | 80971764 | 81267499 |
| 7965 | 5 | 80971764 | 81274512 |
| 7966 | 5 | 80971764 | 81763618 |
| 7967 | 5 | 80971764 | 81797217 |
| 7968 | 5 | 80971764 | 81800186 |
| 7969 | 5 | 80971764 | 81806213 |
| 7970 | 5 | 80971764 | 81854583 |
| 7971 | 5 | 80971764 | 81859374 |
| 7972 | 5 | 80971764 | 81861368 |
| 7973 | 5 | 80971764 | 81863686 |
| 7974 | 5 | 80971764 | 81916850 |
| 7975 | 5 | 80971764 | 81954891 |
| 7976 | 5 | 80971764 | 81985250 |
| 7977 | 5 | 80971764 | 82083752 |
| 7978 | 5 | 80971764 | 82101253 |
| 7979 | 5 | 80971764 | 82143124 |
| 7980 | 5 | 80971764 | 82236318 |
| 7981 | 5 | 80971764 | 82325587 |
| 7982 | 5 | 80971764 | 82427210 |
| 7983 | 5 | 80971764 | 82431853 |
| 7984 | 5 | 80971764 | 82446714 |
| 7985 | 5 | 80971764 | 82446794 |
| 7986 | 5 | 80971764 | 82551111 |
| 7987 | 5 | 80971764 | 82552090 |
| 7988 | 5 | 80971764 | 82555641 |
| 7989 | 5 | 80971764 | 82555670 |
| 7990 | 5 | 80971764 | 82556511 |
| 7991 | 5 | 80971764 | 82559047 |
| 7992 | 5 | 80971764 | 82561535 |
| 7993 | 5 | 80971764 | 82610100 |
| 7994 | 5 | 80971764 | 82676822 |
| 7995 | 5 | 80971764 | 82676901 |
| 7996 | 5 | 80971764 | 82883691 |
| 7997 | 5 | 80971764 | 82954942 |
| 7998 | 5 | 80971764 | 82971688 |
| 7999 | 5 | 80971764 | 83023965 |
| 8000 | 5 | 80971764 | 83094205 |
| 8001 | 5 | 80971764 | 83146355 |
| 8002 | 5 | 80971764 | 83280630 |
| 8003 | 5 | 80971764 | 83281412 |
| 8004 | 5 | 80971764 | 83400242 |
| 8005 | 5 | 80971764 | 83405797 |
| 8006 | 5 | 80971764 | 83437132 |
| 8007 | 5 | 80971764 | 83522252 |
| 8008 | 5 | 80971764 | 83560095 |
| 8009 | 5 | 80971764 | 83560204 |
| 8010 | 5 | 80971764 | 83572400 |
| 8011 | 5 | 80971764 | 83607661 |
| 8012 | 5 | 80971764 | 83745342 |
| 8013 | 5 | 80971764 | 83861275 |
| 8014 | 5 | 80971764 | 83861633 |
| 8015 | 5 | 80971764 | 83865653 |
| 8016 | 5 | 80971764 | 83865914 |
| 8017 | 5 | 80971764 | 83865920 |
| 8018 | 5 | 80971764 | 83868010 |
| 8019 | 5 | 80971764 | 84019752 |
| 8020 | 5 | 80971764 | 84065912 |
| 8021 | 5 | 80971764 | 84086632 |
| 8022 | 5 | 80971764 | 84089603 |
| 8023 | 5 | 80971764 | 84104814 |
| 8024 | 5 | 80971764 | 84105175 |
| 8025 | 5 | 80971764 | 84251635 |
| 8026 | 5 | 80971764 | 84252180 |
| 8027 | 5 | 80971764 | 84253030 |
| 8028 | 5 | 80971764 | 84254208 |
| 8029 | 5 | 80971764 | 84314930 |
| 8030 | 5 | 80971764 | 84340523 |
| 8031 | 5 | 80971764 | 84516340 |
| 8032 | 5 | 80971764 | 84706916 |
| 8033 | 5 | 80971764 | 84799488 |
| 8034 | 5 | 80971764 | 84801081 |
| 8035 | 5 | 80971764 | 84824103 |
| 8036 | 5 | 80971764 | 84824203 |
| 8037 | 5 | 80971764 | 84824816 |
| 8038 | 5 | 80971764 | 84825422 |
| 8039 | 5 | 80971764 | 84825763 |
| 8040 | 5 | 80971764 | 84825942 |
| 8041 | 5 | 80971764 | 84843411 |
| 8042 | 5 | 80971764 | 84936441 |

TABLE 1-continued

Examples of chromosomal segments associated with increased fertility in maize.

| Chromosomal Segment | Chr. | Boundary 1 | Boundary 2 |
|---|---|---|---|
| 8043 | 5 | 80971764 | 84936493 |
| 8044 | 5 | 80971764 | 84943705 |
| 8045 | 5 | 80971764 | 169454950 |
| 8046 | 5 | 80971764 | 181522829 |
| 8047 | 5 | 80971764 | 204759879 |
| 8048 | 5 | 80971764 | 209874191 |
| 8049 | 5 | 81031951 | 81047638 |
| 8050 | 5 | 81031951 | 81082921 |
| 8051 | 5 | 81031951 | 81157909 |
| 8052 | 5 | 81031951 | 81265937 |
| 8053 | 5 | 81031951 | 81265937 |
| 8054 | 5 | 81031951 | 81267485 |
| 8055 | 5 | 81031951 | 81267499 |
| 8056 | 5 | 81031951 | 81274512 |
| 8057 | 5 | 81031951 | 81763618 |
| 8058 | 5 | 81031951 | 81797217 |
| 8059 | 5 | 81031951 | 81800186 |
| 8060 | 5 | 81031951 | 81806213 |
| 8061 | 5 | 81031951 | 81854583 |
| 8062 | 5 | 81031951 | 81859374 |
| 8063 | 5 | 81031951 | 81861368 |
| 8064 | 5 | 81031951 | 81863686 |
| 8065 | 5 | 81031951 | 81916850 |
| 8066 | 5 | 81031951 | 81954891 |
| 8067 | 5 | 81031951 | 81985250 |
| 8068 | 5 | 81031951 | 82083752 |
| 8069 | 5 | 81031951 | 82101253 |
| 8070 | 5 | 81031951 | 82143124 |
| 8071 | 5 | 81031951 | 82236318 |
| 8072 | 5 | 81031951 | 82325587 |
| 8073 | 5 | 81031951 | 82427210 |
| 8074 | 5 | 81031951 | 82431853 |
| 8075 | 5 | 81031951 | 82446714 |
| 8076 | 5 | 81031951 | 82446794 |
| 8077 | 5 | 81031951 | 82551111 |
| 8078 | 5 | 81031951 | 82552090 |
| 8079 | 5 | 81031951 | 82555641 |
| 8080 | 5 | 81031951 | 82555670 |
| 8081 | 5 | 81031951 | 82556511 |
| 8082 | 5 | 81031951 | 82559047 |
| 8083 | 5 | 81031951 | 82561535 |
| 8084 | 5 | 81031951 | 82610100 |
| 8085 | 5 | 81031951 | 82676822 |
| 8086 | 5 | 81031951 | 82676901 |
| 8087 | 5 | 81031951 | 82883691 |
| 8088 | 5 | 81031951 | 82954942 |
| 8089 | 5 | 81031951 | 82971688 |
| 8090 | 5 | 81031951 | 83023965 |
| 8091 | 5 | 81031951 | 83094205 |
| 8092 | 5 | 81031951 | 83146355 |
| 8093 | 5 | 81031951 | 83280630 |
| 8094 | 5 | 81031951 | 83281412 |
| 8095 | 5 | 81031951 | 83400242 |
| 8096 | 5 | 81031951 | 83405797 |
| 8097 | 5 | 81031951 | 83437132 |
| 8098 | 5 | 81031951 | 83522252 |
| 8099 | 5 | 81031951 | 83560095 |
| 8100 | 5 | 81031951 | 83560204 |
| 8101 | 5 | 81031951 | 83572400 |
| 8102 | 5 | 81031951 | 83607661 |
| 8103 | 5 | 81031951 | 83745342 |
| 8104 | 5 | 81031951 | 83861275 |
| 8105 | 5 | 81031951 | 83861633 |
| 8106 | 5 | 81031951 | 83865653 |
| 8107 | 5 | 81031951 | 83865914 |
| 8108 | 5 | 81031951 | 83865920 |
| 8109 | 5 | 81031951 | 83868010 |
| 8110 | 5 | 81031951 | 84019752 |
| 8111 | 5 | 81031951 | 84065912 |
| 8112 | 5 | 81031951 | 84086632 |
| 8113 | 5 | 81031951 | 84089603 |
| 8114 | 5 | 81031951 | 84104814 |
| 8115 | 5 | 81031951 | 84105175 |
| 8116 | 5 | 81031951 | 84251635 |
| 8117 | 5 | 81031951 | 84252180 |
| 8118 | 5 | 81031951 | 84253030 |
| 8119 | 5 | 81031951 | 84254208 |
| 8120 | 5 | 81031951 | 84314930 |
| 8121 | 5 | 81031951 | 84340523 |
| 8122 | 5 | 81031951 | 84516340 |
| 8123 | 5 | 81031951 | 84706916 |
| 8124 | 5 | 81031951 | 84799488 |
| 8125 | 5 | 81031951 | 84801081 |
| 8126 | 5 | 81031951 | 84824103 |
| 8127 | 5 | 81031951 | 84824203 |
| 8128 | 5 | 81031951 | 84824816 |
| 8129 | 5 | 81031951 | 84825422 |
| 8130 | 5 | 81031951 | 84825763 |
| 8131 | 5 | 81031951 | 84825942 |
| 8132 | 5 | 81031951 | 84843411 |
| 8133 | 5 | 81031951 | 84936441 |
| 8134 | 5 | 81031951 | 84936493 |
| 8135 | 5 | 81031951 | 84943705 |
| 8136 | 5 | 81031951 | 169454950 |
| 8137 | 5 | 81031951 | 181522829 |
| 8138 | 5 | 81031951 | 204759879 |
| 8139 | 5 | 81031951 | 209874191 |
| 8140 | 5 | 81076870 | 81082921 |
| 8141 | 5 | 81076870 | 81157909 |
| 8142 | 5 | 81076870 | 81265937 |
| 8143 | 5 | 81076870 | 81265937 |
| 8144 | 5 | 81076870 | 81267485 |
| 8145 | 5 | 81076870 | 81267499 |
| 8146 | 5 | 81076870 | 81274512 |
| 8147 | 5 | 81076870 | 81763618 |
| 8148 | 5 | 81076870 | 81797217 |
| 8149 | 5 | 81076870 | 81800186 |
| 8150 | 5 | 81076870 | 81806213 |
| 8151 | 5 | 81076870 | 81854583 |
| 8152 | 5 | 81076870 | 81859374 |
| 8153 | 5 | 81076870 | 81861368 |
| 8154 | 5 | 81076870 | 81863686 |
| 8155 | 5 | 81076870 | 81916850 |
| 8156 | 5 | 81076870 | 81954891 |
| 8157 | 5 | 81076870 | 81985250 |
| 8158 | 5 | 81076870 | 82083752 |
| 8159 | 5 | 81076870 | 82101253 |
| 8160 | 5 | 81076870 | 82143124 |
| 8161 | 5 | 81076870 | 82236318 |
| 8162 | 5 | 81076870 | 82325587 |
| 8163 | 5 | 81076870 | 82427210 |
| 8164 | 5 | 81076870 | 82431853 |
| 8165 | 5 | 81076870 | 82446714 |
| 8166 | 5 | 81076870 | 82446794 |
| 8167 | 5 | 81076870 | 82551111 |
| 8168 | 5 | 81076870 | 82552090 |
| 8169 | 5 | 81076870 | 82555641 |
| 8170 | 5 | 81076870 | 82555670 |
| 8171 | 5 | 81076870 | 82556511 |
| 8172 | 5 | 81076870 | 82559047 |
| 8173 | 5 | 81076870 | 82561535 |
| 8174 | 5 | 81076870 | 82610100 |
| 8175 | 5 | 81076870 | 82676822 |
| 8176 | 5 | 81076870 | 82676901 |
| 8177 | 5 | 81076870 | 82883691 |
| 8178 | 5 | 81076870 | 82954942 |
| 8179 | 5 | 81076870 | 82971688 |
| 8180 | 5 | 81076870 | 83023965 |
| 8181 | 5 | 81076870 | 83094205 |
| 8182 | 5 | 81076870 | 83146355 |
| 8183 | 5 | 81076870 | 83280630 |
| 8184 | 5 | 81076870 | 83281412 |
| 8185 | 5 | 81076870 | 83400242 |
| 8186 | 5 | 81076870 | 83405797 |
| 8187 | 5 | 81076870 | 83437132 |
| 8188 | 5 | 81076870 | 83522252 |
| 8189 | 5 | 81076870 | 83560095 |
| 8190 | 5 | 81076870 | 83560204 |

TABLE 1-continued

Examples of chromosomal segments associated with increased fertility in maize.

| Chromosomal Segment | Chr. | Boundary 1 | Boundary 2 |
|---|---|---|---|
| 8191 | 5 | 81076870 | 83572400 |
| 8192 | 5 | 81076870 | 83607661 |
| 8193 | 5 | 81076870 | 83745342 |
| 8194 | 5 | 81076870 | 83861275 |
| 8195 | 5 | 81076870 | 83861633 |
| 8196 | 5 | 81076870 | 83865653 |
| 8197 | 5 | 81076870 | 83865914 |
| 8198 | 5 | 81076870 | 83865920 |
| 8199 | 5 | 81076870 | 83868010 |
| 8200 | 5 | 81076870 | 84019752 |
| 8201 | 5 | 81076870 | 84065912 |
| 8202 | 5 | 81076870 | 84086632 |
| 8203 | 5 | 81076870 | 84089603 |
| 8204 | 5 | 81076870 | 84104814 |
| 8205 | 5 | 81076870 | 84105175 |
| 8206 | 5 | 81076870 | 84251635 |
| 8207 | 5 | 81076870 | 84252180 |
| 8208 | 5 | 81076870 | 84253030 |
| 8209 | 5 | 81076870 | 84254208 |
| 8210 | 5 | 81076870 | 84314930 |
| 8211 | 5 | 81076870 | 84340523 |
| 8212 | 5 | 81076870 | 84516340 |
| 8213 | 5 | 81076870 | 84706916 |
| 8214 | 5 | 81076870 | 84799488 |
| 8215 | 5 | 81076870 | 84801081 |
| 8216 | 5 | 81076870 | 84824103 |
| 8217 | 5 | 81076870 | 84824203 |
| 8218 | 5 | 81076870 | 84824816 |
| 8219 | 5 | 81076870 | 84825422 |
| 8220 | 5 | 81076870 | 84825763 |
| 8221 | 5 | 81076870 | 84825942 |
| 8222 | 5 | 81076870 | 84843411 |
| 8223 | 5 | 81076870 | 84936441 |
| 8224 | 5 | 81076870 | 84936493 |
| 8225 | 5 | 81076870 | 84943705 |
| 8226 | 5 | 81076870 | 169454950 |
| 8227 | 5 | 81076870 | 181522829 |
| 8228 | 5 | 81076870 | 204759879 |
| 8229 | 5 | 81076870 | 209874191 |
| 8230 | 5 | 81155197 | 81157909 |
| 8231 | 5 | 81155197 | 81265937 |
| 8232 | 5 | 81155197 | 81265937 |
| 8233 | 5 | 81155197 | 81267485 |
| 8234 | 5 | 81155197 | 81267499 |
| 8235 | 5 | 81155197 | 81274512 |
| 8236 | 5 | 81155197 | 81763618 |
| 8237 | 5 | 81155197 | 81797217 |
| 8238 | 5 | 81155197 | 81800186 |
| 8239 | 5 | 81155197 | 81806213 |
| 8240 | 5 | 81155197 | 81854583 |
| 8241 | 5 | 81155197 | 81859374 |
| 8242 | 5 | 81155197 | 81861368 |
| 8243 | 5 | 81155197 | 81863686 |
| 8244 | 5 | 81155197 | 81916850 |
| 8245 | 5 | 81155197 | 81954891 |
| 8246 | 5 | 81155197 | 81985250 |
| 8247 | 5 | 81155197 | 82083752 |
| 8248 | 5 | 81155197 | 82101253 |
| 8249 | 5 | 81155197 | 82143124 |
| 8250 | 5 | 81155197 | 82236318 |
| 8251 | 5 | 81155197 | 82325587 |
| 8252 | 5 | 81155197 | 82427210 |
| 8253 | 5 | 81155197 | 82431853 |
| 8254 | 5 | 81155197 | 82446714 |
| 8255 | 5 | 81155197 | 82446794 |
| 8256 | 5 | 81155197 | 82551111 |
| 8257 | 5 | 81155197 | 82552090 |
| 8258 | 5 | 81155197 | 82555641 |
| 8259 | 5 | 81155197 | 82555670 |
| 8260 | 5 | 81155197 | 82556511 |
| 8261 | 5 | 81155197 | 82559047 |
| 8262 | 5 | 81155197 | 82561535 |
| 8263 | 5 | 81155197 | 82610100 |
| 8264 | 5 | 81155197 | 82676822 |
| 8265 | 5 | 81155197 | 82676901 |
| 8266 | 5 | 81155197 | 82883691 |
| 8267 | 5 | 81155197 | 82954942 |
| 8268 | 5 | 81155197 | 82971688 |
| 8269 | 5 | 81155197 | 83023965 |
| 8270 | 5 | 81155197 | 83094205 |
| 8271 | 5 | 81155197 | 83146355 |
| 8272 | 5 | 81155197 | 83280630 |
| 8273 | 5 | 81155197 | 83281412 |
| 8274 | 5 | 81155197 | 83400242 |
| 8275 | 5 | 81155197 | 83405797 |
| 8276 | 5 | 81155197 | 83437132 |
| 8277 | 5 | 81155197 | 83522252 |
| 8278 | 5 | 81155197 | 83560095 |
| 8279 | 5 | 81155197 | 83560204 |
| 8280 | 5 | 81155197 | 83572400 |
| 8281 | 5 | 81155197 | 83607661 |
| 8282 | 5 | 81155197 | 83745342 |
| 8283 | 5 | 81155197 | 83861275 |
| 8284 | 5 | 81155197 | 83861633 |
| 8285 | 5 | 81155197 | 83865653 |
| 8286 | 5 | 81155197 | 83865914 |
| 8287 | 5 | 81155197 | 83865920 |
| 8288 | 5 | 81155197 | 83868010 |
| 8289 | 5 | 81155197 | 84019752 |
| 8290 | 5 | 81155197 | 84065912 |
| 8291 | 5 | 81155197 | 84086632 |
| 8292 | 5 | 81155197 | 84089603 |
| 8293 | 5 | 81155197 | 84104814 |
| 8294 | 5 | 81155197 | 84105175 |
| 8295 | 5 | 81155197 | 84251635 |
| 8296 | 5 | 81155197 | 84252180 |
| 8297 | 5 | 81155197 | 84253030 |
| 8298 | 5 | 81155197 | 84254208 |
| 8299 | 5 | 81155197 | 84314930 |
| 8300 | 5 | 81155197 | 84340523 |
| 8301 | 5 | 81155197 | 84516340 |
| 8302 | 5 | 81155197 | 84706916 |
| 8303 | 5 | 81155197 | 84799488 |
| 8304 | 5 | 81155197 | 84801081 |
| 8305 | 5 | 81155197 | 84824103 |
| 8306 | 5 | 81155197 | 84824203 |
| 8307 | 5 | 81155197 | 84824816 |
| 8308 | 5 | 81155197 | 84825422 |
| 8309 | 5 | 81155197 | 84825763 |
| 8310 | 5 | 81155197 | 84825942 |
| 8311 | 5 | 81155197 | 84843411 |
| 8312 | 5 | 81155197 | 84936441 |
| 8313 | 5 | 81155197 | 84936493 |
| 8314 | 5 | 81155197 | 84943705 |
| 8315 | 5 | 81155197 | 169454950 |
| 8316 | 5 | 81155197 | 181522829 |
| 8317 | 5 | 81155197 | 204759879 |
| 8318 | 5 | 81155197 | 209874191 |
| 8319 | 5 | 81155255 | 81157909 |
| 8320 | 5 | 81155255 | 81265937 |
| 8321 | 5 | 81155255 | 81265937 |
| 8322 | 5 | 81155255 | 81267485 |
| 8323 | 5 | 81155255 | 81267499 |
| 8324 | 5 | 81155255 | 81274512 |
| 8325 | 5 | 81155255 | 81763618 |
| 8326 | 5 | 81155255 | 81797217 |
| 8327 | 5 | 81155255 | 81800186 |
| 8328 | 5 | 81155255 | 81806213 |
| 8329 | 5 | 81155255 | 81854583 |
| 8330 | 5 | 81155255 | 81859374 |
| 8331 | 5 | 81155255 | 81861368 |
| 8332 | 5 | 81155255 | 81863686 |
| 8333 | 5 | 81155255 | 81916850 |
| 8334 | 5 | 81155255 | 81954891 |
| 8335 | 5 | 81155255 | 81985250 |
| 8336 | 5 | 81155255 | 82083752 |
| 8337 | 5 | 81155255 | 82101253 |
| 8338 | 5 | 81155255 | 82143124 |

TABLE 1-continued

Examples of chromosomal segments associated with increased fertility in maize.

| Chromosomal Segment | Chr. | Boundary 1 | Boundary 2 |
|---|---|---|---|
| 8339 | 5 | 81155255 | 82236318 |
| 8340 | 5 | 81155255 | 82325587 |
| 8341 | 5 | 81155255 | 82427210 |
| 8342 | 5 | 81155255 | 82431853 |
| 8343 | 5 | 81155255 | 82446714 |
| 8344 | 5 | 81155255 | 82446794 |
| 8345 | 5 | 81155255 | 82551111 |
| 8346 | 5 | 81155255 | 82552090 |
| 8347 | 5 | 81155255 | 82555641 |
| 8348 | 5 | 81155255 | 82555670 |
| 8349 | 5 | 81155255 | 82556511 |
| 8350 | 5 | 81155255 | 82559047 |
| 8351 | 5 | 81155255 | 82561535 |
| 8352 | 5 | 81155255 | 82610100 |
| 8353 | 5 | 81155255 | 82676822 |
| 8354 | 5 | 81155255 | 82676901 |
| 8355 | 5 | 81155255 | 82883691 |
| 8356 | 5 | 81155255 | 82954942 |
| 8357 | 5 | 81155255 | 82971688 |
| 8358 | 5 | 81155255 | 83023965 |
| 8359 | 5 | 81155255 | 83094205 |
| 8360 | 5 | 81155255 | 83146355 |
| 8361 | 5 | 81155255 | 83280630 |
| 8362 | 5 | 81155255 | 83281412 |
| 8363 | 5 | 81155255 | 83400242 |
| 8364 | 5 | 81155255 | 83405797 |
| 8365 | 5 | 81155255 | 83437132 |
| 8366 | 5 | 81155255 | 83522252 |
| 8367 | 5 | 81155255 | 83560095 |
| 8368 | 5 | 81155255 | 83560204 |
| 8369 | 5 | 81155255 | 83572400 |
| 8370 | 5 | 81155255 | 83607661 |
| 8371 | 5 | 81155255 | 83745342 |
| 8372 | 5 | 81155255 | 83861275 |
| 8373 | 5 | 81155255 | 83861633 |
| 8374 | 5 | 81155255 | 83865653 |
| 8375 | 5 | 81155255 | 83865914 |
| 8376 | 5 | 81155255 | 83865920 |
| 8377 | 5 | 81155255 | 83868010 |
| 8378 | 5 | 81155255 | 84019752 |
| 8379 | 5 | 81155255 | 84065912 |
| 8380 | 5 | 81155255 | 84086632 |
| 8381 | 5 | 81155255 | 84089603 |
| 8382 | 5 | 81155255 | 84104814 |
| 8383 | 5 | 81155255 | 84105175 |
| 8384 | 5 | 81155255 | 84251635 |
| 8385 | 5 | 81155255 | 84252180 |
| 8386 | 5 | 81155255 | 84253030 |
| 8387 | 5 | 81155255 | 84254208 |
| 8388 | 5 | 81155255 | 84314930 |
| 8389 | 5 | 81155255 | 84340523 |
| 8390 | 5 | 81155255 | 84516340 |
| 8391 | 5 | 81155255 | 84706916 |
| 8392 | 5 | 81155255 | 84799488 |
| 8393 | 5 | 81155255 | 84801081 |
| 8394 | 5 | 81155255 | 84824103 |
| 8395 | 5 | 81155255 | 84824203 |
| 8396 | 5 | 81155255 | 84824816 |
| 8397 | 5 | 81155255 | 84825422 |
| 8398 | 5 | 81155255 | 84825763 |
| 8399 | 5 | 81155255 | 84825942 |
| 8400 | 5 | 81155255 | 84843411 |
| 8401 | 5 | 81155255 | 84936441 |
| 8402 | 5 | 81155255 | 84936493 |
| 8403 | 5 | 81155255 | 84943705 |
| 8404 | 5 | 81155255 | 169454950 |
| 8405 | 5 | 81155255 | 181522829 |
| 8406 | 5 | 81155255 | 204759879 |
| 8407 | 5 | 81155255 | 209874191 |
| 8408 | 5 | 81155675 | 81157909 |
| 8409 | 5 | 81155675 | 81265937 |
| 8410 | 5 | 81155675 | 81265937 |
| 8411 | 5 | 81155675 | 81267485 |
| 8412 | 5 | 81155675 | 81267499 |
| 8413 | 5 | 81155675 | 81274512 |
| 8414 | 5 | 81155675 | 81763618 |
| 8415 | 5 | 81155675 | 81797217 |
| 8416 | 5 | 81155675 | 81800186 |
| 8417 | 5 | 81155675 | 81806213 |
| 8418 | 5 | 81155675 | 81854583 |
| 8419 | 5 | 81155675 | 81859374 |
| 8420 | 5 | 81155675 | 81861368 |
| 8421 | 5 | 81155675 | 81863686 |
| 8422 | 5 | 81155675 | 81916850 |
| 8423 | 5 | 81155675 | 81954891 |
| 8424 | 5 | 81155675 | 81985250 |
| 8425 | 5 | 81155675 | 82083752 |
| 8426 | 5 | 81155675 | 82101253 |
| 8427 | 5 | 81155675 | 82143124 |
| 8428 | 5 | 81155675 | 82236318 |
| 8429 | 5 | 81155675 | 82325587 |
| 8430 | 5 | 81155675 | 82427210 |
| 8431 | 5 | 81155675 | 82431853 |
| 8432 | 5 | 81155675 | 82446714 |
| 8433 | 5 | 81155675 | 82446794 |
| 8434 | 5 | 81155675 | 82551111 |
| 8435 | 5 | 81155675 | 82552090 |
| 8436 | 5 | 81155675 | 82555641 |
| 8437 | 5 | 81155675 | 82555670 |
| 8438 | 5 | 81155675 | 82556511 |
| 8439 | 5 | 81155675 | 82559047 |
| 8440 | 5 | 81155675 | 82561535 |
| 8441 | 5 | 81155675 | 82610100 |
| 8442 | 5 | 81155675 | 82676822 |
| 8443 | 5 | 81155675 | 82676901 |
| 8444 | 5 | 81155675 | 82883691 |
| 8445 | 5 | 81155675 | 82954942 |
| 8446 | 5 | 81155675 | 82971688 |
| 8447 | 5 | 81155675 | 83023965 |
| 8448 | 5 | 81155675 | 83094205 |
| 8449 | 5 | 81155675 | 83146355 |
| 8450 | 5 | 81155675 | 83280630 |
| 8451 | 5 | 81155675 | 83281412 |
| 8452 | 5 | 81155675 | 83400242 |
| 8453 | 5 | 81155675 | 83405797 |
| 8454 | 5 | 81155675 | 83437132 |
| 8455 | 5 | 81155675 | 83522252 |
| 8456 | 5 | 81155675 | 83560095 |
| 8457 | 5 | 81155675 | 83560204 |
| 8458 | 5 | 81155675 | 83572400 |
| 8459 | 5 | 81155675 | 83607661 |
| 8460 | 5 | 81155675 | 83745342 |
| 8461 | 5 | 81155675 | 83861275 |
| 8462 | 5 | 81155675 | 83861633 |
| 8463 | 5 | 81155675 | 83865653 |
| 8464 | 5 | 81155675 | 83865914 |
| 8465 | 5 | 81155675 | 83865920 |
| 8466 | 5 | 81155675 | 83868010 |
| 8467 | 5 | 81155675 | 84019752 |
| 8468 | 5 | 81155675 | 84065912 |
| 8469 | 5 | 81155675 | 84086632 |
| 8470 | 5 | 81155675 | 84089603 |
| 8471 | 5 | 81155675 | 84104814 |
| 8472 | 5 | 81155675 | 84105175 |
| 8473 | 5 | 81155675 | 84251635 |
| 8474 | 5 | 81155675 | 84252180 |
| 8475 | 5 | 81155675 | 84253030 |
| 8476 | 5 | 81155675 | 84254208 |
| 8477 | 5 | 81155675 | 84314930 |
| 8478 | 5 | 81155675 | 84340523 |
| 8479 | 5 | 81155675 | 84516340 |
| 8480 | 5 | 81155675 | 84706916 |
| 8481 | 5 | 81155675 | 84799488 |
| 8482 | 5 | 81155675 | 84801081 |
| 8483 | 5 | 81155675 | 84824103 |
| 8484 | 5 | 81155675 | 84824203 |
| 8485 | 5 | 81155675 | 84824816 |
| 8486 | 5 | 81155675 | 84825422 |

TABLE 1-continued

Examples of chromosomal segments associated with increased fertility in maize.

| Chromosomal Segment | Chr. | Boundary 1 | Boundary 2 |
|---|---|---|---|
| 8487 | 5 | 81155675 | 84825763 |
| 8488 | 5 | 81155675 | 84825942 |
| 8489 | 5 | 81155675 | 84843411 |
| 8490 | 5 | 81155675 | 84936441 |
| 8491 | 5 | 81155675 | 84936493 |
| 8492 | 5 | 81155675 | 84943705 |
| 8493 | 5 | 81155675 | 169454950 |
| 8494 | 5 | 81155675 | 181522829 |
| 8495 | 5 | 81155675 | 204759879 |
| 8496 | 5 | 81155675 | 209874191 |
| 8497 | 5 | 81156713 | 81157909 |
| 8498 | 5 | 81156713 | 81265937 |
| 8499 | 5 | 81156713 | 81265937 |
| 8500 | 5 | 81156713 | 81267485 |
| 8501 | 5 | 81156713 | 81267499 |
| 8502 | 5 | 81156713 | 81274512 |
| 8503 | 5 | 81156713 | 81763618 |
| 8504 | 5 | 81156713 | 81797217 |
| 8505 | 5 | 81156713 | 81800186 |
| 8506 | 5 | 81156713 | 81806213 |
| 8507 | 5 | 81156713 | 81854583 |
| 8508 | 5 | 81156713 | 81859374 |
| 8509 | 5 | 81156713 | 81861368 |
| 8510 | 5 | 81156713 | 81863686 |
| 8511 | 5 | 81156713 | 81916850 |
| 8512 | 5 | 81156713 | 81954891 |
| 8513 | 5 | 81156713 | 81985250 |
| 8514 | 5 | 81156713 | 82083752 |
| 8515 | 5 | 81156713 | 82101253 |
| 8516 | 5 | 81156713 | 82143124 |
| 8517 | 5 | 81156713 | 82236318 |
| 8518 | 5 | 81156713 | 82325587 |
| 8519 | 5 | 81156713 | 82427210 |
| 8520 | 5 | 81156713 | 82431853 |
| 8521 | 5 | 81156713 | 82446714 |
| 8522 | 5 | 81156713 | 82446794 |
| 8523 | 5 | 81156713 | 82551111 |
| 8524 | 5 | 81156713 | 82552090 |
| 8525 | 5 | 81156713 | 82555641 |
| 8526 | 5 | 81156713 | 82555670 |
| 8527 | 5 | 81156713 | 82556511 |
| 8528 | 5 | 81156713 | 82559047 |
| 8529 | 5 | 81156713 | 82561535 |
| 8530 | 5 | 81156713 | 82610100 |
| 8531 | 5 | 81156713 | 82676822 |
| 8532 | 5 | 81156713 | 82676901 |
| 8533 | 5 | 81156713 | 82883691 |
| 8534 | 5 | 81156713 | 82954942 |
| 8535 | 5 | 81156713 | 82971688 |
| 8536 | 5 | 81156713 | 83023965 |
| 8537 | 5 | 81156713 | 83094205 |
| 8538 | 5 | 81156713 | 83146355 |
| 8539 | 5 | 81156713 | 83280630 |
| 8540 | 5 | 81156713 | 83281412 |
| 8541 | 5 | 81156713 | 83400242 |
| 8542 | 5 | 81156713 | 83405797 |
| 8543 | 5 | 81156713 | 83437132 |
| 8544 | 5 | 81156713 | 83522252 |
| 8545 | 5 | 81156713 | 83560095 |
| 8546 | 5 | 81156713 | 83560204 |
| 8547 | 5 | 81156713 | 83572400 |
| 8548 | 5 | 81156713 | 83607661 |
| 8549 | 5 | 81156713 | 83745342 |
| 8550 | 5 | 81156713 | 83861275 |
| 8551 | 5 | 81156713 | 83861633 |
| 8552 | 5 | 81156713 | 83865653 |
| 8553 | 5 | 81156713 | 83865914 |
| 8554 | 5 | 81156713 | 83865920 |
| 8555 | 5 | 81156713 | 83868010 |
| 8556 | 5 | 81156713 | 84019752 |
| 8557 | 5 | 81156713 | 84065912 |
| 8558 | 5 | 81156713 | 84086632 |
| 8559 | 5 | 81156713 | 84089603 |
| 8560 | 5 | 81156713 | 84104814 |
| 8561 | 5 | 81156713 | 84105175 |
| 8562 | 5 | 81156713 | 84251635 |
| 8563 | 5 | 81156713 | 84252180 |
| 8564 | 5 | 81156713 | 84253030 |
| 8565 | 5 | 81156713 | 84254208 |
| 8566 | 5 | 81156713 | 84314930 |
| 8567 | 5 | 81156713 | 84340523 |
| 8568 | 5 | 81156713 | 84516340 |
| 8569 | 5 | 81156713 | 84706916 |
| 8570 | 5 | 81156713 | 84799488 |
| 8571 | 5 | 81156713 | 84801081 |
| 8572 | 5 | 81156713 | 84824103 |
| 8573 | 5 | 81156713 | 84824203 |
| 8574 | 5 | 81156713 | 84824816 |
| 8575 | 5 | 81156713 | 84825422 |
| 8576 | 5 | 81156713 | 84825763 |
| 8577 | 5 | 81156713 | 84825942 |
| 8578 | 5 | 81156713 | 84843411 |
| 8579 | 5 | 81156713 | 84936441 |
| 8580 | 5 | 81156713 | 84936493 |
| 8581 | 5 | 81156713 | 84943705 |
| 8582 | 5 | 81156713 | 169454950 |
| 8583 | 5 | 81156713 | 181522829 |
| 8584 | 5 | 81156713 | 204759879 |
| 8585 | 5 | 81156713 | 209874191 |
| 8586 | 5 | 81265211 | 81265937 |
| 8587 | 5 | 81265211 | 81265937 |
| 8588 | 5 | 81265211 | 81267485 |
| 8589 | 5 | 81265211 | 81267499 |
| 8590 | 5 | 81265211 | 81274512 |
| 8591 | 5 | 81265211 | 81763618 |
| 8592 | 5 | 81265211 | 81797217 |
| 8593 | 5 | 81265211 | 81800186 |
| 8594 | 5 | 81265211 | 81806213 |
| 8595 | 5 | 81265211 | 81854583 |
| 8596 | 5 | 81265211 | 81859374 |
| 8597 | 5 | 81265211 | 81861368 |
| 8598 | 5 | 81265211 | 81863686 |
| 8599 | 5 | 81265211 | 81916850 |
| 8600 | 5 | 81265211 | 81954891 |
| 8601 | 5 | 81265211 | 81985250 |
| 8602 | 5 | 81265211 | 82083752 |
| 8603 | 5 | 81265211 | 82101253 |
| 8604 | 5 | 81265211 | 82143124 |
| 8605 | 5 | 81265211 | 82236318 |
| 8606 | 5 | 81265211 | 82325587 |
| 8607 | 5 | 81265211 | 82427210 |
| 8608 | 5 | 81265211 | 82431853 |
| 8609 | 5 | 81265211 | 82446714 |
| 8610 | 5 | 81265211 | 82446794 |
| 8611 | 5 | 81265211 | 82551111 |
| 8612 | 5 | 81265211 | 82552090 |
| 8613 | 5 | 81265211 | 82555641 |
| 8614 | 5 | 81265211 | 82555670 |
| 8615 | 5 | 81265211 | 82556511 |
| 8616 | 5 | 81265211 | 82559047 |
| 8617 | 5 | 81265211 | 82561535 |
| 8618 | 5 | 81265211 | 82610100 |
| 8619 | 5 | 81265211 | 82676822 |
| 8620 | 5 | 81265211 | 82676901 |
| 8621 | 5 | 81265211 | 82883691 |
| 8622 | 5 | 81265211 | 82954942 |
| 8623 | 5 | 81265211 | 82971688 |
| 8624 | 5 | 81265211 | 83023965 |
| 8625 | 5 | 81265211 | 83094205 |
| 8626 | 5 | 81265211 | 83146355 |
| 8627 | 5 | 81265211 | 83280630 |
| 8628 | 5 | 81265211 | 83281412 |
| 8629 | 5 | 81265211 | 83400242 |
| 8630 | 5 | 81265211 | 83405797 |
| 8631 | 5 | 81265211 | 83437132 |
| 8632 | 5 | 81265211 | 83522252 |
| 8633 | 5 | 81265211 | 83560095 |
| 8634 | 5 | 81265211 | 83560204 |

TABLE 1-continued

Examples of chromosomal segments associated with increased fertility in maize.

| Chromosomal Segment | Chr. | Boundary 1 | Boundary 2 |
|---|---|---|---|
| 8635 | 5 | 81265211 | 83572400 |
| 8636 | 5 | 81265211 | 83607661 |
| 8637 | 5 | 81265211 | 83745342 |
| 8638 | 5 | 81265211 | 83861275 |
| 8639 | 5 | 81265211 | 83861633 |
| 8640 | 5 | 81265211 | 83865653 |
| 8641 | 5 | 81265211 | 83865914 |
| 8642 | 5 | 81265211 | 83865920 |
| 8643 | 5 | 81265211 | 83868010 |
| 8644 | 5 | 81265211 | 84019752 |
| 8645 | 5 | 81265211 | 84065912 |
| 8646 | 5 | 81265211 | 84086632 |
| 8647 | 5 | 81265211 | 84089603 |
| 8648 | 5 | 81265211 | 84104814 |
| 8649 | 5 | 81265211 | 84105175 |
| 8650 | 5 | 81265211 | 84251635 |
| 8651 | 5 | 81265211 | 84252180 |
| 8652 | 5 | 81265211 | 84253030 |
| 8653 | 5 | 81265211 | 84254208 |
| 8654 | 5 | 81265211 | 84314930 |
| 8655 | 5 | 81265211 | 84340523 |
| 8656 | 5 | 81265211 | 84516340 |
| 8657 | 5 | 81265211 | 84706916 |
| 8658 | 5 | 81265211 | 84799488 |
| 8659 | 5 | 81265211 | 84801081 |
| 8660 | 5 | 81265211 | 84824103 |
| 8661 | 5 | 81265211 | 84824203 |
| 8662 | 5 | 81265211 | 84824816 |
| 8663 | 5 | 81265211 | 84825422 |
| 8664 | 5 | 81265211 | 84825763 |
| 8665 | 5 | 81265211 | 84825942 |
| 8666 | 5 | 81265211 | 84843411 |
| 8667 | 5 | 81265211 | 84936441 |
| 8668 | 5 | 81265211 | 84936493 |
| 8669 | 5 | 81265211 | 84943705 |
| 8670 | 5 | 81265211 | 169454950 |
| 8671 | 5 | 81265211 | 181522829 |
| 8672 | 5 | 81265211 | 204759879 |
| 8673 | 5 | 81265211 | 209874191 |
| 8674 | 5 | 81265354 | 81265937 |
| 8675 | 5 | 81265354 | 81265937 |
| 8676 | 5 | 81265354 | 81267485 |
| 8677 | 5 | 81265354 | 81274512 |
| 8678 | 5 | 81265354 | 81763618 |
| 8679 | 5 | 81265354 | 81797217 |
| 8680 | 5 | 81265354 | 81800186 |
| 8681 | 5 | 81265354 | 81806213 |
| 8682 | 5 | 81265354 | 81854583 |
| 8683 | 5 | 81265354 | 81859374 |
| 8684 | 5 | 81265354 | 81861368 |
| 8685 | 5 | 81265354 | 81863686 |
| 8686 | 5 | 81265354 | 81916850 |
| 8687 | 5 | 81265354 | 81954891 |
| 8688 | 5 | 81265354 | 81985250 |
| 8689 | 5 | 81265354 | 82083752 |
| 8690 | 5 | 81265354 | 82101253 |
| 8691 | 5 | 81265354 | 82143124 |
| 8692 | 5 | 81265354 | 82236318 |
| 8693 | 5 | 81265354 | 82325587 |
| 8694 | 5 | 81265354 | 82427210 |
| 8695 | 5 | 81265354 | 82431853 |
| 8696 | 5 | 81265354 | 82446714 |
| 8697 | 5 | 81265354 | 82446794 |
| 8698 | 5 | 81265354 | 82551111 |
| 8699 | 5 | 81265354 | 82552090 |
| 8700 | 5 | 81265354 | 82555641 |
| 8701 | 5 | 81265354 | 82555670 |
| 8702 | 5 | 81265354 | 82556511 |
| 8703 | 5 | 81265354 | 82559047 |
| 8704 | 5 | 81265354 | 82561535 |
| 8705 | 5 | 81265354 | 82610100 |
| 8706 | 5 | 81265354 | 82676822 |
| 8707 | 5 | 81265354 | 82676901 |
| 8708 | 5 | 81265354 | 82883691 |
| 8709 | 5 | 81265354 | 82954942 |
| 8710 | 5 | 81265354 | 82971688 |
| 8711 | 5 | 81265354 | 83023965 |
| 8712 | 5 | 81265354 | 83094205 |
| 8713 | 5 | 81265354 | 83146355 |
| 8714 | 5 | 81265354 | 83280630 |
| 8715 | 5 | 81265354 | 83281412 |
| 8716 | 5 | 81265354 | 83400242 |
| 8717 | 5 | 81265354 | 83405797 |
| 8718 | 5 | 81265354 | 83437132 |
| 8719 | 5 | 81265354 | 83522252 |
| 8720 | 5 | 81265354 | 83560095 |
| 8721 | 5 | 81265354 | 83560204 |
| 8722 | 5 | 81265354 | 83572400 |
| 8723 | 5 | 81265354 | 83607661 |
| 8724 | 5 | 81265354 | 83745342 |
| 8725 | 5 | 81265354 | 83861275 |
| 8726 | 5 | 81265354 | 83861633 |
| 8727 | 5 | 81265354 | 83865653 |
| 8728 | 5 | 81265354 | 83865914 |
| 8729 | 5 | 81265354 | 83865920 |
| 8730 | 5 | 81265354 | 83868010 |
| 8731 | 5 | 81265354 | 84019752 |
| 8732 | 5 | 81265354 | 84065912 |
| 8733 | 5 | 81265354 | 84086632 |
| 8734 | 5 | 81265354 | 84089603 |
| 8735 | 5 | 81265354 | 84104814 |
| 8736 | 5 | 81265354 | 84105175 |
| 8737 | 5 | 81265354 | 84251635 |
| 8738 | 5 | 81265354 | 84252180 |
| 8739 | 5 | 81265354 | 84253030 |
| 8740 | 5 | 81265354 | 84254208 |
| 8741 | 5 | 81265354 | 84314930 |
| 8742 | 5 | 81265354 | 84340523 |
| 8743 | 5 | 81265354 | 84516340 |
| 8744 | 5 | 81265354 | 84706916 |
| 8745 | 5 | 81265354 | 84799488 |
| 8746 | 5 | 81265354 | 84801081 |
| 8747 | 5 | 81265354 | 84824103 |
| 8748 | 5 | 81265354 | 84824203 |
| 8749 | 5 | 81265354 | 84824816 |
| 8750 | 5 | 81265354 | 84825422 |
| 8751 | 5 | 81265354 | 84825763 |
| 8752 | 5 | 81265354 | 84825942 |
| 8753 | 5 | 81265354 | 84843411 |
| 8754 | 5 | 81265354 | 84936441 |
| 8755 | 5 | 81265354 | 84936493 |
| 8756 | 5 | 81265354 | 84943705 |
| 8757 | 5 | 81265354 | 169454950 |
| 8758 | 5 | 81265354 | 181522829 |
| 8759 | 5 | 81265354 | 204759879 |
| 8760 | 5 | 81265354 | 209874191 |
| 8761 | 5 | 81265937 | 81274512 |
| 8762 | 5 | 81265937 | 81763618 |
| 8763 | 5 | 81265937 | 81797217 |
| 8764 | 5 | 81265937 | 81800186 |
| 8765 | 5 | 81265937 | 81806213 |
| 8766 | 5 | 81265937 | 81854583 |
| 8767 | 5 | 81265937 | 81859374 |
| 8768 | 5 | 81265937 | 81861368 |
| 8769 | 5 | 81265937 | 81863686 |
| 8770 | 5 | 81265937 | 81916850 |
| 8771 | 5 | 81265937 | 81954891 |
| 8772 | 5 | 81265937 | 81985250 |
| 8773 | 5 | 81265937 | 82083752 |
| 8774 | 5 | 81265937 | 82101253 |
| 8775 | 5 | 81265937 | 82143124 |
| 8776 | 5 | 81265937 | 82236318 |
| 8777 | 5 | 81265937 | 82325587 |
| 8778 | 5 | 81265937 | 82427210 |
| 8779 | 5 | 81265937 | 82431853 |
| 8780 | 5 | 81265937 | 82446714 |
| 8781 | 5 | 81265937 | 82446794 |
| 8782 | 5 | 81265937 | 82551111 |

TABLE 1-continued

Examples of chromosomal segments associated with increased fertility in maize.

| Chromosomal Segment | Chr. | Boundary 1 | Boundary 2 |
|---|---|---|---|
| 8783 | 5 | 81265937 | 82552090 |
| 8784 | 5 | 81265937 | 82555641 |
| 8785 | 5 | 81265937 | 82555670 |
| 8786 | 5 | 81265937 | 82556511 |
| 8787 | 5 | 81265937 | 82559047 |
| 8788 | 5 | 81265937 | 82561535 |
| 8789 | 5 | 81265937 | 82610100 |
| 8790 | 5 | 81265937 | 82676822 |
| 8791 | 5 | 81265937 | 82676901 |
| 8792 | 5 | 81265937 | 82883691 |
| 8793 | 5 | 81265937 | 82954942 |
| 8794 | 5 | 81265937 | 82971688 |
| 8795 | 5 | 81265937 | 83023965 |
| 8796 | 5 | 81265937 | 83094205 |
| 8797 | 5 | 81265937 | 83146355 |
| 8798 | 5 | 81265937 | 83280630 |
| 8799 | 5 | 81265937 | 83281412 |
| 8800 | 5 | 81265937 | 83400242 |
| 8801 | 5 | 81265937 | 83405797 |
| 8802 | 5 | 81265937 | 83437132 |
| 8803 | 5 | 81265937 | 83522252 |
| 8804 | 5 | 81265937 | 83560095 |
| 8805 | 5 | 81265937 | 83560204 |
| 8806 | 5 | 81265937 | 83572400 |
| 8807 | 5 | 81265937 | 83607661 |
| 8808 | 5 | 81265937 | 83745342 |
| 8809 | 5 | 81265937 | 83861275 |
| 8810 | 5 | 81265937 | 83861633 |
| 8811 | 5 | 81265937 | 83865653 |
| 8812 | 5 | 81265937 | 83865914 |
| 8813 | 5 | 81265937 | 83865920 |
| 8814 | 5 | 81265937 | 83868010 |
| 8815 | 5 | 81265937 | 84019752 |
| 8816 | 5 | 81265937 | 84065912 |
| 8817 | 5 | 81265937 | 84086632 |
| 8818 | 5 | 81265937 | 84089603 |
| 8819 | 5 | 81265937 | 84104814 |
| 8820 | 5 | 81265937 | 84105175 |
| 8821 | 5 | 81265937 | 84251635 |
| 8822 | 5 | 81265937 | 84252180 |
| 8823 | 5 | 81265937 | 84253030 |
| 8824 | 5 | 81265937 | 84254208 |
| 8825 | 5 | 81265937 | 84314930 |
| 8826 | 5 | 81265937 | 84340523 |
| 8827 | 5 | 81265937 | 84516340 |
| 8828 | 5 | 81265937 | 84706916 |
| 8829 | 5 | 81265937 | 84799488 |
| 8830 | 5 | 81265937 | 84801081 |
| 8831 | 5 | 81265937 | 84824103 |
| 8832 | 5 | 81265937 | 84824203 |
| 8833 | 5 | 81265937 | 84824816 |
| 8834 | 5 | 81265937 | 84825422 |
| 8835 | 5 | 81265937 | 84825763 |
| 8836 | 5 | 81265937 | 84825942 |
| 8837 | 5 | 81265937 | 84843411 |
| 8838 | 5 | 81265937 | 84936441 |
| 8839 | 5 | 81265937 | 84936493 |
| 8840 | 5 | 81265937 | 84943705 |
| 8841 | 5 | 81265937 | 169454950 |
| 8842 | 5 | 81265937 | 181522829 |
| 8843 | 5 | 81265937 | 204759879 |
| 8844 | 5 | 81265937 | 209874191 |
| 8845 | 5 | 81273796 | 81265937 |
| 8846 | 5 | 81273796 | 81274512 |
| 8847 | 5 | 81273796 | 81763618 |
| 8848 | 5 | 81273796 | 81797217 |
| 8849 | 5 | 81273796 | 81800186 |
| 8850 | 5 | 81273796 | 81806213 |
| 8851 | 5 | 81273796 | 81854583 |
| 8852 | 5 | 81273796 | 81859374 |
| 8853 | 5 | 81273796 | 81861368 |
| 8854 | 5 | 81273796 | 81863686 |
| 8855 | 5 | 81273796 | 81916850 |
| 8856 | 5 | 81273796 | 81954891 |
| 8857 | 5 | 81273796 | 81985250 |
| 8858 | 5 | 81273796 | 82083752 |
| 8859 | 5 | 81273796 | 82101253 |
| 8860 | 5 | 81273796 | 82143124 |
| 8861 | 5 | 81273796 | 82236318 |
| 8862 | 5 | 81273796 | 82325587 |
| 8863 | 5 | 81273796 | 82427210 |
| 8864 | 5 | 81273796 | 82431853 |
| 8865 | 5 | 81273796 | 82446714 |
| 8866 | 5 | 81273796 | 82446794 |
| 8867 | 5 | 81273796 | 82551111 |
| 8868 | 5 | 81273796 | 82552090 |
| 8869 | 5 | 81273796 | 82555641 |
| 8870 | 5 | 81273796 | 82555670 |
| 8871 | 5 | 81273796 | 82556511 |
| 8872 | 5 | 81273796 | 82559047 |
| 8873 | 5 | 81273796 | 82561535 |
| 8874 | 5 | 81273796 | 82610100 |
| 8875 | 5 | 81273796 | 82676822 |
| 8876 | 5 | 81273796 | 82676901 |
| 8877 | 5 | 81273796 | 82883691 |
| 8878 | 5 | 81273796 | 82954942 |
| 8879 | 5 | 81273796 | 82971688 |
| 8880 | 5 | 81273796 | 83023965 |
| 8881 | 5 | 81273796 | 83094205 |
| 8882 | 5 | 81273796 | 83146355 |
| 8883 | 5 | 81273796 | 83280630 |
| 8884 | 5 | 81273796 | 83281412 |
| 8885 | 5 | 81273796 | 83400242 |
| 8886 | 5 | 81273796 | 83405797 |
| 8887 | 5 | 81273796 | 83437132 |
| 8888 | 5 | 81273796 | 83522252 |
| 8889 | 5 | 81273796 | 83560095 |
| 8890 | 5 | 81273796 | 83560204 |
| 8891 | 5 | 81273796 | 83572400 |
| 8892 | 5 | 81273796 | 83607661 |
| 8893 | 5 | 81273796 | 83745342 |
| 8894 | 5 | 81273796 | 83861275 |
| 8895 | 5 | 81273796 | 83861633 |
| 8896 | 5 | 81273796 | 83865653 |
| 8897 | 5 | 81273796 | 83865914 |
| 8898 | 5 | 81273796 | 83865920 |
| 8899 | 5 | 81273796 | 83868010 |
| 8900 | 5 | 81273796 | 84019752 |
| 8901 | 5 | 81273796 | 84065912 |
| 8902 | 5 | 81273796 | 84086632 |
| 8903 | 5 | 81273796 | 84089603 |
| 8904 | 5 | 81273796 | 84104814 |
| 8905 | 5 | 81273796 | 84105175 |
| 8906 | 5 | 81273796 | 84251635 |
| 8907 | 5 | 81273796 | 84252180 |
| 8908 | 5 | 81273796 | 84253030 |
| 8909 | 5 | 81273796 | 84254208 |
| 8910 | 5 | 81273796 | 84314930 |
| 8911 | 5 | 81273796 | 84340523 |
| 8912 | 5 | 81273796 | 84516340 |
| 8913 | 5 | 81273796 | 84706916 |
| 8914 | 5 | 81273796 | 84799488 |
| 8915 | 5 | 81273796 | 84801081 |
| 8916 | 5 | 81273796 | 84824103 |
| 8917 | 5 | 81273796 | 84824203 |
| 8918 | 5 | 81273796 | 84824816 |
| 8919 | 5 | 81273796 | 84825422 |
| 8920 | 5 | 81273796 | 84825763 |
| 8921 | 5 | 81273796 | 84825942 |
| 8922 | 5 | 81273796 | 84843411 |
| 8923 | 5 | 81273796 | 84936441 |
| 8924 | 5 | 81273796 | 84936493 |
| 8925 | 5 | 81273796 | 84943705 |
| 8926 | 5 | 81273796 | 169454950 |
| 8927 | 5 | 81273796 | 181522829 |
| 8928 | 5 | 81273796 | 204759879 |
| 8929 | 5 | 81273796 | 209874191 |
| 8930 | 5 | 81761119 | 81265937 |

TABLE 1-continued

Examples of chromosomal segments associated with increased fertility in maize.

| Chromosomal Segment | Chr. | Boundary 1 | Boundary 2 |
| --- | --- | --- | --- |
| 8931 | 5 | 81761119 | 81265937 |
| 8932 | 5 | 81761119 | 81267485 |
| 8933 | 5 | 81761119 | 81267499 |
| 8934 | 5 | 81761119 | 81274512 |
| 8935 | 5 | 81761119 | 81763618 |
| 8936 | 5 | 81761119 | 81797217 |
| 8937 | 5 | 81761119 | 81800186 |
| 8938 | 5 | 81761119 | 81806213 |
| 8939 | 5 | 81761119 | 81854583 |
| 8940 | 5 | 81761119 | 81859374 |
| 8941 | 5 | 81761119 | 81861368 |
| 8942 | 5 | 81761119 | 81863686 |
| 8943 | 5 | 81761119 | 81916850 |
| 8944 | 5 | 81761119 | 81954891 |
| 8945 | 5 | 81761119 | 81985250 |
| 8946 | 5 | 81761119 | 82083752 |
| 8947 | 5 | 81761119 | 82101253 |
| 8948 | 5 | 81761119 | 82143124 |
| 8949 | 5 | 81761119 | 82236318 |
| 8950 | 5 | 81761119 | 82325587 |
| 8951 | 5 | 81761119 | 82427210 |
| 8952 | 5 | 81761119 | 82431853 |
| 8953 | 5 | 81761119 | 82446714 |
| 8954 | 5 | 81761119 | 82446794 |
| 8955 | 5 | 81761119 | 82551111 |
| 8956 | 5 | 81761119 | 82552090 |
| 8957 | 5 | 81761119 | 82555641 |
| 8958 | 5 | 81761119 | 82555670 |
| 8959 | 5 | 81761119 | 82556511 |
| 8960 | 5 | 81761119 | 82559047 |
| 8961 | 5 | 81761119 | 82561535 |
| 8962 | 5 | 81761119 | 82610100 |
| 8963 | 5 | 81761119 | 82676822 |
| 8964 | 5 | 81761119 | 82676901 |
| 8965 | 5 | 81761119 | 82883691 |
| 8966 | 5 | 81761119 | 82954942 |
| 8967 | 5 | 81761119 | 82971688 |
| 8968 | 5 | 81761119 | 83023965 |
| 8969 | 5 | 81761119 | 83094205 |
| 8970 | 5 | 81761119 | 83146355 |
| 8971 | 5 | 81761119 | 83280630 |
| 8972 | 5 | 81761119 | 83281412 |
| 8973 | 5 | 81761119 | 83400242 |
| 8974 | 5 | 81761119 | 83405797 |
| 8975 | 5 | 81761119 | 83437132 |
| 8976 | 5 | 81761119 | 83522252 |
| 8977 | 5 | 81761119 | 83560095 |
| 8978 | 5 | 81761119 | 83560204 |
| 8979 | 5 | 81761119 | 83572400 |
| 8980 | 5 | 81761119 | 83607661 |
| 8981 | 5 | 81761119 | 83745342 |
| 8982 | 5 | 81761119 | 83861275 |
| 8983 | 5 | 81761119 | 83861633 |
| 8984 | 5 | 81761119 | 83865653 |
| 8985 | 5 | 81761119 | 83865914 |
| 8986 | 5 | 81761119 | 83865920 |
| 8987 | 5 | 81761119 | 83868010 |
| 8988 | 5 | 81761119 | 84019752 |
| 8989 | 5 | 81761119 | 84065912 |
| 8990 | 5 | 81761119 | 84086632 |
| 8991 | 5 | 81761119 | 84089603 |
| 8992 | 5 | 81761119 | 84104814 |
| 8993 | 5 | 81761119 | 84105175 |
| 8994 | 5 | 81761119 | 84251635 |
| 8995 | 5 | 81761119 | 84252180 |
| 8996 | 5 | 81761119 | 84253030 |
| 8997 | 5 | 81761119 | 84254208 |
| 8998 | 5 | 81761119 | 84314930 |
| 8999 | 5 | 81761119 | 84340523 |
| 9000 | 5 | 81761119 | 84516340 |
| 9001 | 5 | 81761119 | 84706916 |
| 9002 | 5 | 81761119 | 84799488 |
| 9003 | 5 | 81761119 | 84801081 |
| 9004 | 5 | 81761119 | 84824103 |
| 9005 | 5 | 81761119 | 84824203 |
| 9006 | 5 | 81761119 | 84824816 |
| 9007 | 5 | 81761119 | 84825422 |
| 9008 | 5 | 81761119 | 84825763 |
| 9009 | 5 | 81761119 | 84825942 |
| 9010 | 5 | 81761119 | 84843411 |
| 9011 | 5 | 81761119 | 84936441 |
| 9012 | 5 | 81761119 | 84936493 |
| 9013 | 5 | 81761119 | 84943705 |
| 9014 | 5 | 81761119 | 169454950 |
| 9015 | 5 | 81761119 | 181522829 |
| 9016 | 5 | 81761119 | 204759879 |
| 9017 | 5 | 81761119 | 209874191 |
| 9018 | 5 | 81793777 | 81265937 |
| 9019 | 5 | 81793777 | 81797217 |
| 9020 | 5 | 81793777 | 81800186 |
| 9021 | 5 | 81793777 | 81806213 |
| 9022 | 5 | 81793777 | 81854583 |
| 9023 | 5 | 81793777 | 81859374 |
| 9024 | 5 | 81793777 | 81861368 |
| 9025 | 5 | 81793777 | 81863686 |
| 9026 | 5 | 81793777 | 81916850 |
| 9027 | 5 | 81793777 | 81954891 |
| 9028 | 5 | 81793777 | 81985250 |
| 9029 | 5 | 81793777 | 82083752 |
| 9030 | 5 | 81793777 | 82101253 |
| 9031 | 5 | 81793777 | 82143124 |
| 9032 | 5 | 81793777 | 82236318 |
| 9033 | 5 | 81793777 | 82325587 |
| 9034 | 5 | 81793777 | 82427210 |
| 9035 | 5 | 81793777 | 82431853 |
| 9036 | 5 | 81793777 | 82446714 |
| 9037 | 5 | 81793777 | 82446794 |
| 9038 | 5 | 81793777 | 82551111 |
| 9039 | 5 | 81793777 | 82552090 |
| 9040 | 5 | 81793777 | 82555641 |
| 9041 | 5 | 81793777 | 82555670 |
| 9042 | 5 | 81793777 | 82556511 |
| 9043 | 5 | 81793777 | 82559047 |
| 9044 | 5 | 81793777 | 82561535 |
| 9045 | 5 | 81793777 | 82610100 |
| 9046 | 5 | 81793777 | 82676822 |
| 9047 | 5 | 81793777 | 82676901 |
| 9048 | 5 | 81793777 | 82883691 |
| 9049 | 5 | 81793777 | 82954942 |
| 9050 | 5 | 81793777 | 82971688 |
| 9051 | 5 | 81793777 | 83023965 |
| 9052 | 5 | 81793777 | 83094205 |
| 9053 | 5 | 81793777 | 83146355 |
| 9054 | 5 | 81793777 | 83280630 |
| 9055 | 5 | 81793777 | 83281412 |
| 9056 | 5 | 81793777 | 83400242 |
| 9057 | 5 | 81793777 | 83405797 |
| 9058 | 5 | 81793777 | 83437132 |
| 9059 | 5 | 81793777 | 83522252 |
| 9060 | 5 | 81793777 | 83560095 |
| 9061 | 5 | 81793777 | 83560204 |
| 9062 | 5 | 81793777 | 83572400 |
| 9063 | 5 | 81793777 | 83607661 |
| 9064 | 5 | 81793777 | 83745342 |
| 9065 | 5 | 81793777 | 83861275 |
| 9066 | 5 | 81793777 | 83861633 |
| 9067 | 5 | 81793777 | 83865653 |
| 9068 | 5 | 81793777 | 83865914 |
| 9069 | 5 | 81793777 | 83865920 |
| 9070 | 5 | 81793777 | 83868010 |
| 9071 | 5 | 81793777 | 84019752 |
| 9072 | 5 | 81793777 | 84065912 |
| 9073 | 5 | 81793777 | 84086632 |
| 9074 | 5 | 81793777 | 84089603 |
| 9075 | 5 | 81793777 | 84104814 |
| 9076 | 5 | 81793777 | 84105175 |
| 9077 | 5 | 81793777 | 84251635 |
| 9078 | 5 | 81793777 | 84252180 |

TABLE 1-continued

Examples of chromosomal segments associated with increased fertility in maize.

| Chromosomal Segment | Chr. | Boundary 1 | Boundary 2 |
|---|---|---|---|
| 9079 | 5 | 81793777 | 84253030 |
| 9080 | 5 | 81793777 | 84254208 |
| 9081 | 5 | 81793777 | 84314930 |
| 9082 | 5 | 81793777 | 84340523 |
| 9083 | 5 | 81793777 | 84516340 |
| 9084 | 5 | 81793777 | 84706916 |
| 9085 | 5 | 81793777 | 84799488 |
| 9086 | 5 | 81793777 | 84801081 |
| 9087 | 5 | 81793777 | 84824103 |
| 9088 | 5 | 81793777 | 84824203 |
| 9089 | 5 | 81793777 | 84824816 |
| 9090 | 5 | 81793777 | 84825422 |
| 9091 | 5 | 81793777 | 84825763 |
| 9092 | 5 | 81793777 | 84825942 |
| 9093 | 5 | 81793777 | 84843411 |
| 9094 | 5 | 81793777 | 84936441 |
| 9095 | 5 | 81793777 | 84936493 |
| 9096 | 5 | 81793777 | 84943705 |
| 9097 | 5 | 81793777 | 169454950 |
| 9098 | 5 | 81793777 | 181522829 |
| 9099 | 5 | 81793777 | 204759879 |
| 9100 | 5 | 81793777 | 209874191 |
| 9101 | 5 | 81798893 | 81265937 |
| 9102 | 5 | 81798893 | 81800186 |
| 9103 | 5 | 81798893 | 81806213 |
| 9104 | 5 | 81798893 | 81854583 |
| 9105 | 5 | 81798893 | 81859374 |
| 9106 | 5 | 81798893 | 81861368 |
| 9107 | 5 | 81798893 | 81863686 |
| 9108 | 5 | 81798893 | 81916850 |
| 9109 | 5 | 81798893 | 81954891 |
| 9110 | 5 | 81798893 | 81985250 |
| 9111 | 5 | 81798893 | 82083752 |
| 9112 | 5 | 81798893 | 82101253 |
| 9113 | 5 | 81798893 | 82143124 |
| 9114 | 5 | 81798893 | 82236318 |
| 9115 | 5 | 81798893 | 82325587 |
| 9116 | 5 | 81798893 | 82427210 |
| 9117 | 5 | 81798893 | 82431853 |
| 9118 | 5 | 81798893 | 82446714 |
| 9119 | 5 | 81798893 | 82446794 |
| 9120 | 5 | 81798893 | 82551111 |
| 9121 | 5 | 81798893 | 82552090 |
| 9122 | 5 | 81798893 | 82555641 |
| 9123 | 5 | 81798893 | 82555670 |
| 9124 | 5 | 81798893 | 82556511 |
| 9125 | 5 | 81798893 | 82559047 |
| 9126 | 5 | 81798893 | 82561535 |
| 9127 | 5 | 81798893 | 82610100 |
| 9128 | 5 | 81798893 | 82676822 |
| 9129 | 5 | 81798893 | 82676901 |
| 9130 | 5 | 81798893 | 82883691 |
| 9131 | 5 | 81798893 | 82954942 |
| 9132 | 5 | 81798893 | 82971688 |
| 9133 | 5 | 81798893 | 83023965 |
| 9134 | 5 | 81798893 | 83094205 |
| 9135 | 5 | 81798893 | 83146355 |
| 9136 | 5 | 81798893 | 83280630 |
| 9137 | 5 | 81798893 | 83281412 |
| 9138 | 5 | 81798893 | 83400242 |
| 9139 | 5 | 81798893 | 83405797 |
| 9140 | 5 | 81798893 | 83437132 |
| 9141 | 5 | 81798893 | 83522252 |
| 9142 | 5 | 81798893 | 83560095 |
| 9143 | 5 | 81798893 | 83560204 |
| 9144 | 5 | 81798893 | 83572400 |
| 9145 | 5 | 81798893 | 83607661 |
| 9146 | 5 | 81798893 | 83745342 |
| 9147 | 5 | 81798893 | 83861275 |
| 9148 | 5 | 81798893 | 83861633 |
| 9149 | 5 | 81798893 | 83865653 |
| 9150 | 5 | 81798893 | 83865914 |
| 9151 | 5 | 81798893 | 83865920 |
| 9152 | 5 | 81798893 | 83868010 |
| 9153 | 5 | 81798893 | 84019752 |
| 9154 | 5 | 81798893 | 84065912 |
| 9155 | 5 | 81798893 | 84086632 |
| 9156 | 5 | 81798893 | 84089603 |
| 9157 | 5 | 81798893 | 84104814 |
| 9158 | 5 | 81798893 | 84105175 |
| 9159 | 5 | 81798893 | 84251635 |
| 9160 | 5 | 81798893 | 84252180 |
| 9161 | 5 | 81798893 | 84253030 |
| 9162 | 5 | 81798893 | 84254208 |
| 9163 | 5 | 81798893 | 84314930 |
| 9164 | 5 | 81798893 | 84340523 |
| 9165 | 5 | 81798893 | 84516340 |
| 9166 | 5 | 81798893 | 84706916 |
| 9167 | 5 | 81798893 | 84799488 |
| 9168 | 5 | 81798893 | 84801081 |
| 9169 | 5 | 81798893 | 84824103 |
| 9170 | 5 | 81798893 | 84824203 |
| 9171 | 5 | 81798893 | 84824816 |
| 9172 | 5 | 81798893 | 84825422 |
| 9173 | 5 | 81798893 | 84825763 |
| 9174 | 5 | 81798893 | 84825942 |
| 9175 | 5 | 81798893 | 84843411 |
| 9176 | 5 | 81798893 | 84936441 |
| 9177 | 5 | 81798893 | 84936493 |
| 9178 | 5 | 81798893 | 84943705 |
| 9179 | 5 | 81798893 | 169454950 |
| 9180 | 5 | 81798893 | 181522829 |
| 9181 | 5 | 81798893 | 204759879 |
| 9182 | 5 | 81798893 | 209874191 |
| 9183 | 5 | 81801973 | 81265937 |
| 9184 | 5 | 81801973 | 81806213 |
| 9185 | 5 | 81801973 | 81854583 |
| 9186 | 5 | 81801973 | 81859374 |
| 9187 | 5 | 81801973 | 81861368 |
| 9188 | 5 | 81801973 | 81863686 |
| 9189 | 5 | 81801973 | 81916850 |
| 9190 | 5 | 81801973 | 81954891 |
| 9191 | 5 | 81801973 | 81985250 |
| 9192 | 5 | 81801973 | 82083752 |
| 9193 | 5 | 81801973 | 82101253 |
| 9194 | 5 | 81801973 | 82143124 |
| 9195 | 5 | 81801973 | 82236318 |
| 9196 | 5 | 81801973 | 82325587 |
| 9197 | 5 | 81801973 | 82427210 |
| 9198 | 5 | 81801973 | 82431853 |
| 9199 | 5 | 81801973 | 82446714 |
| 9200 | 5 | 81801973 | 82446794 |
| 9201 | 5 | 81801973 | 82551111 |
| 9202 | 5 | 81801973 | 82552090 |
| 9203 | 5 | 81801973 | 82555641 |
| 9204 | 5 | 81801973 | 82555670 |
| 9205 | 5 | 81801973 | 82556511 |
| 9206 | 5 | 81801973 | 82559047 |
| 9207 | 5 | 81801973 | 82561535 |
| 9208 | 5 | 81801973 | 82610100 |
| 9209 | 5 | 81801973 | 82676822 |
| 9210 | 5 | 81801973 | 82676901 |
| 9211 | 5 | 81801973 | 82883691 |
| 9212 | 5 | 81801973 | 82954942 |
| 9213 | 5 | 81801973 | 82971688 |
| 9214 | 5 | 81801973 | 83023965 |
| 9215 | 5 | 81801973 | 83094205 |
| 9216 | 5 | 81801973 | 83146355 |
| 9217 | 5 | 81801973 | 83280630 |
| 9218 | 5 | 81801973 | 83281412 |
| 9219 | 5 | 81801973 | 83400242 |
| 9220 | 5 | 81801973 | 83405797 |
| 9221 | 5 | 81801973 | 83437132 |
| 9222 | 5 | 81801973 | 83522252 |
| 9223 | 5 | 81801973 | 83560095 |
| 9224 | 5 | 81801973 | 83560204 |
| 9225 | 5 | 81801973 | 83572400 |
| 9226 | 5 | 81801973 | 83607661 |

TABLE 1-continued

Examples of chromosomal segments associated with increased fertility in maize.

| Chromosomal Segment | Chr. | Boundary 1 | Boundary 2 |
|---|---|---|---|
| 9227 | 5 | 81801973 | 83745342 |
| 9228 | 5 | 81801973 | 83861275 |
| 9229 | 5 | 81801973 | 83861633 |
| 9230 | 5 | 81801973 | 83865653 |
| 9231 | 5 | 81801973 | 83865914 |
| 9232 | 5 | 81801973 | 83865920 |
| 9233 | 5 | 81801973 | 83868010 |
| 9234 | 5 | 81801973 | 84019752 |
| 9235 | 5 | 81801973 | 84065912 |
| 9236 | 5 | 81801973 | 84086632 |
| 9237 | 5 | 81801973 | 84089603 |
| 9238 | 5 | 81801973 | 84104814 |
| 9239 | 5 | 81801973 | 84105175 |
| 9240 | 5 | 81801973 | 84251635 |
| 9241 | 5 | 81801973 | 84252180 |
| 9242 | 5 | 81801973 | 84253030 |
| 9243 | 5 | 81801973 | 84254208 |
| 9244 | 5 | 81801973 | 84314930 |
| 9245 | 5 | 81801973 | 84340523 |
| 9246 | 5 | 81801973 | 84516340 |
| 9247 | 5 | 81801973 | 84706916 |
| 9248 | 5 | 81801973 | 84799488 |
| 9249 | 5 | 81801973 | 84801081 |
| 9250 | 5 | 81801973 | 84824103 |
| 9251 | 5 | 81801973 | 84824203 |
| 9252 | 5 | 81801973 | 84824816 |
| 9253 | 5 | 81801973 | 84825422 |
| 9254 | 5 | 81801973 | 84825763 |
| 9255 | 5 | 81801973 | 84825942 |
| 9256 | 5 | 81801973 | 84843411 |
| 9257 | 5 | 81801973 | 84936441 |
| 9258 | 5 | 81801973 | 84936493 |
| 9259 | 5 | 81801973 | 84943705 |
| 9260 | 5 | 81801973 | 169454950 |
| 9261 | 5 | 81801973 | 181522829 |
| 9262 | 5 | 81801973 | 204759879 |
| 9263 | 5 | 81801973 | 209874191 |
| 9264 | 5 | 81854583 | 81859374 |
| 9265 | 5 | 81854583 | 81861368 |
| 9266 | 5 | 81854583 | 81863686 |
| 9267 | 5 | 81854583 | 81916850 |
| 9268 | 5 | 81854583 | 81954891 |
| 9269 | 5 | 81854583 | 81985250 |
| 9270 | 5 | 81854583 | 82083752 |
| 9271 | 5 | 81854583 | 82101253 |
| 9272 | 5 | 81854583 | 82143124 |
| 9273 | 5 | 81854583 | 82236318 |
| 9274 | 5 | 81854583 | 82325587 |
| 9275 | 5 | 81854583 | 82427210 |
| 9276 | 5 | 81854583 | 82431853 |
| 9277 | 5 | 81854583 | 82446714 |
| 9278 | 5 | 81854583 | 82446794 |
| 9279 | 5 | 81854583 | 82551111 |
| 9280 | 5 | 81854583 | 82552090 |
| 9281 | 5 | 81854583 | 82555641 |
| 9282 | 5 | 81854583 | 82555670 |
| 9283 | 5 | 81854583 | 82556511 |
| 9284 | 5 | 81854583 | 82559047 |
| 9285 | 5 | 81854583 | 82561535 |
| 9286 | 5 | 81854583 | 82610100 |
| 9287 | 5 | 81854583 | 82676822 |
| 9288 | 5 | 81854583 | 82676901 |
| 9289 | 5 | 81854583 | 82883691 |
| 9290 | 5 | 81854583 | 82954942 |
| 9291 | 5 | 81854583 | 82971688 |
| 9292 | 5 | 81854583 | 83023965 |
| 9293 | 5 | 81854583 | 83094205 |
| 9294 | 5 | 81854583 | 83146355 |
| 9295 | 5 | 81854583 | 83280630 |
| 9296 | 5 | 81854583 | 83281412 |
| 9297 | 5 | 81854583 | 83400242 |
| 9298 | 5 | 81854583 | 83405797 |
| 9299 | 5 | 81854583 | 83437132 |
| 9300 | 5 | 81854583 | 83522252 |
| 9301 | 5 | 81854583 | 83560095 |
| 9302 | 5 | 81854583 | 83560204 |
| 9303 | 5 | 81854583 | 83572400 |
| 9304 | 5 | 81854583 | 83607661 |
| 9305 | 5 | 81854583 | 83745342 |
| 9306 | 5 | 81854583 | 83861275 |
| 9307 | 5 | 81854583 | 83861633 |
| 9308 | 5 | 81854583 | 83865653 |
| 9309 | 5 | 81854583 | 83865914 |
| 9310 | 5 | 81854583 | 83865920 |
| 9311 | 5 | 81854583 | 83868010 |
| 9312 | 5 | 81854583 | 84019752 |
| 9313 | 5 | 81854583 | 84065912 |
| 9314 | 5 | 81854583 | 84086632 |
| 9315 | 5 | 81854583 | 84089603 |
| 9316 | 5 | 81854583 | 84104814 |
| 9317 | 5 | 81854583 | 84105175 |
| 9318 | 5 | 81854583 | 84251635 |
| 9319 | 5 | 81854583 | 84252180 |
| 9320 | 5 | 81854583 | 84253030 |
| 9321 | 5 | 81854583 | 84254208 |
| 9322 | 5 | 81854583 | 84314930 |
| 9323 | 5 | 81854583 | 84340523 |
| 9324 | 5 | 81854583 | 84516340 |
| 9325 | 5 | 81854583 | 84706916 |
| 9326 | 5 | 81854583 | 84799488 |
| 9327 | 5 | 81854583 | 84801081 |
| 9328 | 5 | 81854583 | 84824103 |
| 9329 | 5 | 81854583 | 84824203 |
| 9330 | 5 | 81854583 | 84824816 |
| 9331 | 5 | 81854583 | 84825422 |
| 9332 | 5 | 81854583 | 84825763 |
| 9333 | 5 | 81854583 | 84825942 |
| 9334 | 5 | 81854583 | 84843411 |
| 9335 | 5 | 81854583 | 84936441 |
| 9336 | 5 | 81854583 | 84936493 |
| 9337 | 5 | 81854583 | 84943705 |
| 9338 | 5 | 81854583 | 169454950 |
| 9339 | 5 | 81854583 | 181522829 |
| 9340 | 5 | 81854583 | 204759879 |
| 9341 | 5 | 81854583 | 209874191 |
| 9342 | 5 | 81858527 | 81859374 |
| 9343 | 5 | 81858527 | 81861368 |
| 9344 | 5 | 81858527 | 81863686 |
| 9345 | 5 | 81858527 | 81916850 |
| 9346 | 5 | 81858527 | 81954891 |
| 9347 | 5 | 81858527 | 81985250 |
| 9348 | 5 | 81858527 | 82083752 |
| 9349 | 5 | 81858527 | 82101253 |
| 9350 | 5 | 81858527 | 82143124 |
| 9351 | 5 | 81858527 | 82236318 |
| 9352 | 5 | 81858527 | 82325587 |
| 9353 | 5 | 81858527 | 82427210 |
| 9354 | 5 | 81858527 | 82431853 |
| 9355 | 5 | 81858527 | 82446714 |
| 9356 | 5 | 81858527 | 82446794 |
| 9357 | 5 | 81858527 | 82551111 |
| 9358 | 5 | 81858527 | 82552090 |
| 9359 | 5 | 81858527 | 82555641 |
| 9360 | 5 | 81858527 | 82555670 |
| 9361 | 5 | 81858527 | 82556511 |
| 9362 | 5 | 81858527 | 82559047 |
| 9363 | 5 | 81858527 | 82561535 |
| 9364 | 5 | 81858527 | 82610100 |
| 9365 | 5 | 81858527 | 82676822 |
| 9366 | 5 | 81858527 | 82676901 |
| 9367 | 5 | 81858527 | 82883691 |
| 9368 | 5 | 81858527 | 82954942 |
| 9369 | 5 | 81858527 | 82971688 |
| 9370 | 5 | 81858527 | 83023965 |
| 9371 | 5 | 81858527 | 83094205 |
| 9372 | 5 | 81858527 | 83146355 |
| 9373 | 5 | 81858527 | 83280630 |
| 9374 | 5 | 81858527 | 83281412 |

TABLE 1-continued

Examples of chromosomal segments associated with increased fertility in maize.

| Chromosomal Segment | Chr. | Boundary 1 | Boundary 2 |
|---|---|---|---|
| 9375 | 5 | 81858527 | 83400242 |
| 9376 | 5 | 81858527 | 83405797 |
| 9377 | 5 | 81858527 | 83437132 |
| 9378 | 5 | 81858527 | 83522252 |
| 9379 | 5 | 81858527 | 83560095 |
| 9380 | 5 | 81858527 | 83560204 |
| 9381 | 5 | 81858527 | 83572400 |
| 9382 | 5 | 81858527 | 83607661 |
| 9383 | 5 | 81858527 | 83745342 |
| 9384 | 5 | 81858527 | 83861275 |
| 9385 | 5 | 81858527 | 83861633 |
| 9386 | 5 | 81858527 | 83865653 |
| 9387 | 5 | 81858527 | 83865914 |
| 9388 | 5 | 81858527 | 83865920 |
| 9389 | 5 | 81858527 | 83868010 |
| 9390 | 5 | 81858527 | 84019752 |
| 9391 | 5 | 81858527 | 84065912 |
| 9392 | 5 | 81858527 | 84086632 |
| 9393 | 5 | 81858527 | 84089603 |
| 9394 | 5 | 81858527 | 84104814 |
| 9395 | 5 | 81858527 | 84105175 |
| 9396 | 5 | 81858527 | 84251635 |
| 9397 | 5 | 81858527 | 84252180 |
| 9398 | 5 | 81858527 | 84253030 |
| 9399 | 5 | 81858527 | 84254208 |
| 9400 | 5 | 81858527 | 84314930 |
| 9401 | 5 | 81858527 | 84340523 |
| 9402 | 5 | 81858527 | 84516340 |
| 9403 | 5 | 81858527 | 84706916 |
| 9404 | 5 | 81858527 | 84799488 |
| 9405 | 5 | 81858527 | 84801081 |
| 9406 | 5 | 81858527 | 84824103 |
| 9407 | 5 | 81858527 | 84824203 |
| 9408 | 5 | 81858527 | 84824816 |
| 9409 | 5 | 81858527 | 84825422 |
| 9410 | 5 | 81858527 | 84825763 |
| 9411 | 5 | 81858527 | 84825942 |
| 9412 | 5 | 81858527 | 84843411 |
| 9413 | 5 | 81858527 | 84936441 |
| 9414 | 5 | 81858527 | 84936493 |
| 9415 | 5 | 81858527 | 84943705 |
| 9416 | 5 | 81858527 | 169454950 |
| 9417 | 5 | 81858527 | 181522829 |
| 9418 | 5 | 81858527 | 204759879 |
| 9419 | 5 | 81858527 | 209874191 |
| 9420 | 5 | 81859618 | 81265937 |
| 9421 | 5 | 81859618 | 81861368 |
| 9422 | 5 | 81859618 | 81863686 |
| 9423 | 5 | 81859618 | 81916850 |
| 9424 | 5 | 81859618 | 81954891 |
| 9425 | 5 | 81859618 | 81985250 |
| 9426 | 5 | 81859618 | 82083752 |
| 9427 | 5 | 81859618 | 82101253 |
| 9428 | 5 | 81859618 | 82143124 |
| 9429 | 5 | 81859618 | 82236318 |
| 9430 | 5 | 81859618 | 82325587 |
| 9431 | 5 | 81859618 | 82427210 |
| 9432 | 5 | 81859618 | 82431853 |
| 9433 | 5 | 81859618 | 82446714 |
| 9434 | 5 | 81859618 | 82446794 |
| 9435 | 5 | 81859618 | 82551111 |
| 9436 | 5 | 81859618 | 82552090 |
| 9437 | 5 | 81859618 | 82555641 |
| 9438 | 5 | 81859618 | 82555670 |
| 9439 | 5 | 81859618 | 82556511 |
| 9440 | 5 | 81859618 | 82559047 |
| 9441 | 5 | 81859618 | 82561535 |
| 9442 | 5 | 81859618 | 82610100 |
| 9443 | 5 | 81859618 | 82676822 |
| 9444 | 5 | 81859618 | 82676901 |
| 9445 | 5 | 81859618 | 82883691 |
| 9446 | 5 | 81859618 | 82954942 |
| 9447 | 5 | 81859618 | 82971688 |
| 9448 | 5 | 81859618 | 83023965 |
| 9449 | 5 | 81859618 | 83094205 |
| 9450 | 5 | 81859618 | 83146355 |
| 9451 | 5 | 81859618 | 83280630 |
| 9452 | 5 | 81859618 | 83281412 |
| 9453 | 5 | 81859618 | 83400242 |
| 9454 | 5 | 81859618 | 83405797 |
| 9455 | 5 | 81859618 | 83437132 |
| 9456 | 5 | 81859618 | 83522252 |
| 9457 | 5 | 81859618 | 83560095 |
| 9458 | 5 | 81859618 | 83560204 |
| 9459 | 5 | 81859618 | 83572400 |
| 9460 | 5 | 81859618 | 83607661 |
| 9461 | 5 | 81859618 | 83745342 |
| 9462 | 5 | 81859618 | 83861275 |
| 9463 | 5 | 81859618 | 83861633 |
| 9464 | 5 | 81859618 | 83865653 |
| 9465 | 5 | 81859618 | 83865914 |
| 9466 | 5 | 81859618 | 83865920 |
| 9467 | 5 | 81859618 | 83868010 |
| 9468 | 5 | 81859618 | 84019752 |
| 9469 | 5 | 81859618 | 84065912 |
| 9470 | 5 | 81859618 | 84086632 |
| 9471 | 5 | 81859618 | 84089603 |
| 9472 | 5 | 81859618 | 84104814 |
| 9473 | 5 | 81859618 | 84105175 |
| 9474 | 5 | 81859618 | 84251635 |
| 9475 | 5 | 81859618 | 84252180 |
| 9476 | 5 | 81859618 | 84253030 |
| 9477 | 5 | 81859618 | 84254208 |
| 9478 | 5 | 81859618 | 84314930 |
| 9479 | 5 | 81859618 | 84340523 |
| 9480 | 5 | 81859618 | 84516340 |
| 9481 | 5 | 81859618 | 84706916 |
| 9482 | 5 | 81859618 | 84799488 |
| 9483 | 5 | 81859618 | 84801081 |
| 9484 | 5 | 81859618 | 84824103 |
| 9485 | 5 | 81859618 | 84824203 |
| 9486 | 5 | 81859618 | 84824816 |
| 9487 | 5 | 81859618 | 84825422 |
| 9488 | 5 | 81859618 | 84825763 |
| 9489 | 5 | 81859618 | 84825942 |
| 9490 | 5 | 81859618 | 84843411 |
| 9491 | 5 | 81859618 | 84936441 |
| 9492 | 5 | 81859618 | 84936493 |
| 9493 | 5 | 81859618 | 84943705 |
| 9494 | 5 | 81859618 | 169454950 |
| 9495 | 5 | 81859618 | 181522829 |
| 9496 | 5 | 81859618 | 204759879 |
| 9497 | 5 | 81859618 | 209874191 |
| 9498 | 5 | 81863099 | 81265937 |
| 9499 | 5 | 81863099 | 81863686 |
| 9500 | 5 | 81863099 | 81916850 |
| 9501 | 5 | 81863099 | 81954891 |
| 9502 | 5 | 81863099 | 81985250 |
| 9503 | 5 | 81863099 | 82083752 |
| 9504 | 5 | 81863099 | 82101253 |
| 9505 | 5 | 81863099 | 82143124 |
| 9506 | 5 | 81863099 | 82236318 |
| 9507 | 5 | 81863099 | 82325587 |
| 9508 | 5 | 81863099 | 82427210 |
| 9509 | 5 | 81863099 | 82431853 |
| 9510 | 5 | 81863099 | 82446714 |
| 9511 | 5 | 81863099 | 82446794 |
| 9512 | 5 | 81863099 | 82551111 |
| 9513 | 5 | 81863099 | 82552090 |
| 9514 | 5 | 81863099 | 82555641 |
| 9515 | 5 | 81863099 | 82555670 |
| 9516 | 5 | 81863099 | 82556511 |
| 9517 | 5 | 81863099 | 82559047 |
| 9518 | 5 | 81863099 | 82561535 |
| 9519 | 5 | 81863099 | 82610100 |
| 9520 | 5 | 81863099 | 82676822 |
| 9521 | 5 | 81863099 | 82676901 |
| 9522 | 5 | 81863099 | 82883691 |

TABLE 1-continued

Examples of chromosomal segments associated with increased fertility in maize.

| Chromosomal Segment | Chr. | Boundary 1 | Boundary 2 |
|---|---|---|---|
| 9523 | 5 | 81863099 | 82954942 |
| 9524 | 5 | 81863099 | 82971688 |
| 9525 | 5 | 81863099 | 83023965 |
| 9526 | 5 | 81863099 | 83094205 |
| 9527 | 5 | 81863099 | 83146355 |
| 9528 | 5 | 81863099 | 83280630 |
| 9529 | 5 | 81863099 | 83281412 |
| 9530 | 5 | 81863099 | 83400242 |
| 9531 | 5 | 81863099 | 83405797 |
| 9532 | 5 | 81863099 | 83437132 |
| 9533 | 5 | 81863099 | 83522252 |
| 9534 | 5 | 81863099 | 83560095 |
| 9535 | 5 | 81863099 | 83560204 |
| 9536 | 5 | 81863099 | 83572400 |
| 9537 | 5 | 81863099 | 83607661 |
| 9538 | 5 | 81863099 | 83745342 |
| 9539 | 5 | 81863099 | 83861275 |
| 9540 | 5 | 81863099 | 83861633 |
| 9541 | 5 | 81863099 | 83865653 |
| 9542 | 5 | 81863099 | 83865914 |
| 9543 | 5 | 81863099 | 83865920 |
| 9544 | 5 | 81863099 | 83868010 |
| 9545 | 5 | 81863099 | 84019752 |
| 9546 | 5 | 81863099 | 84065912 |
| 9547 | 5 | 81863099 | 84086632 |
| 9548 | 5 | 81863099 | 84089603 |
| 9549 | 5 | 81863099 | 84104814 |
| 9550 | 5 | 81863099 | 84105175 |
| 9551 | 5 | 81863099 | 84251635 |
| 9552 | 5 | 81863099 | 84252180 |
| 9553 | 5 | 81863099 | 84253030 |
| 9554 | 5 | 81863099 | 84254208 |
| 9555 | 5 | 81863099 | 84314930 |
| 9556 | 5 | 81863099 | 84340523 |
| 9557 | 5 | 81863099 | 84516340 |
| 9558 | 5 | 81863099 | 84706916 |
| 9559 | 5 | 81863099 | 84799488 |
| 9560 | 5 | 81863099 | 84801081 |
| 9561 | 5 | 81863099 | 84824103 |
| 9562 | 5 | 81863099 | 84824203 |
| 9563 | 5 | 81863099 | 84824816 |
| 9564 | 5 | 81863099 | 84825422 |
| 9565 | 5 | 81863099 | 84825763 |
| 9566 | 5 | 81863099 | 84825942 |
| 9567 | 5 | 81863099 | 84843411 |
| 9568 | 5 | 81863099 | 84936441 |
| 9569 | 5 | 81863099 | 84936493 |
| 9570 | 5 | 81863099 | 84943705 |
| 9571 | 5 | 81863099 | 169454950 |
| 9572 | 5 | 81863099 | 181522829 |
| 9573 | 5 | 81863099 | 204759879 |
| 9574 | 5 | 81863099 | 209874191 |
| 9575 | 5 | 81914498 | 81265937 |
| 9576 | 5 | 81914498 | 81916850 |
| 9577 | 5 | 81914498 | 81954891 |
| 9578 | 5 | 81914498 | 81985250 |
| 9579 | 5 | 81914498 | 82083752 |
| 9580 | 5 | 81914498 | 82101253 |
| 9581 | 5 | 81914498 | 82143124 |
| 9582 | 5 | 81914498 | 82236318 |
| 9583 | 5 | 81914498 | 82325587 |
| 9584 | 5 | 81914498 | 82427210 |
| 9585 | 5 | 81914498 | 82431853 |
| 9586 | 5 | 81914498 | 82446714 |
| 9587 | 5 | 81914498 | 82446794 |
| 9588 | 5 | 81914498 | 82551111 |
| 9589 | 5 | 81914498 | 82552090 |
| 9590 | 5 | 81914498 | 82555641 |
| 9591 | 5 | 81914498 | 82555670 |
| 9592 | 5 | 81914498 | 82556511 |
| 9593 | 5 | 81914498 | 82559047 |
| 9594 | 5 | 81914498 | 82561535 |
| 9595 | 5 | 81914498 | 82610100 |
| 9596 | 5 | 81914498 | 82676822 |
| 9597 | 5 | 81914498 | 82676901 |
| 9598 | 5 | 81914498 | 82883691 |
| 9599 | 5 | 81914498 | 82954942 |
| 9600 | 5 | 81914498 | 82971688 |
| 9601 | 5 | 81914498 | 83023965 |
| 9602 | 5 | 81914498 | 83094205 |
| 9603 | 5 | 81914498 | 83146355 |
| 9604 | 5 | 81914498 | 83280630 |
| 9605 | 5 | 81914498 | 83281412 |
| 9606 | 5 | 81914498 | 83400242 |
| 9607 | 5 | 81914498 | 83405797 |
| 9608 | 5 | 81914498 | 83437132 |
| 9609 | 5 | 81914498 | 83522252 |
| 9610 | 5 | 81914498 | 83560095 |
| 9611 | 5 | 81914498 | 83560204 |
| 9612 | 5 | 81914498 | 83572400 |
| 9613 | 5 | 81914498 | 83607661 |
| 9614 | 5 | 81914498 | 83745342 |
| 9615 | 5 | 81914498 | 83861275 |
| 9616 | 5 | 81914498 | 83861633 |
| 9617 | 5 | 81914498 | 83865653 |
| 9618 | 5 | 81914498 | 83865914 |
| 9619 | 5 | 81914498 | 83865920 |
| 9620 | 5 | 81914498 | 83868010 |
| 9621 | 5 | 81914498 | 84019752 |
| 9622 | 5 | 81914498 | 84065912 |
| 9623 | 5 | 81914498 | 84086632 |
| 9624 | 5 | 81914498 | 84089603 |
| 9625 | 5 | 81914498 | 84104814 |
| 9626 | 5 | 81914498 | 84105175 |
| 9627 | 5 | 81914498 | 84251635 |
| 9628 | 5 | 81914498 | 84252180 |
| 9629 | 5 | 81914498 | 84253030 |
| 9630 | 5 | 81914498 | 84254208 |
| 9631 | 5 | 81914498 | 84314930 |
| 9632 | 5 | 81914498 | 84340523 |
| 9633 | 5 | 81914498 | 84516340 |
| 9634 | 5 | 81914498 | 84706916 |
| 9635 | 5 | 81914498 | 84799488 |
| 9636 | 5 | 81914498 | 84801081 |
| 9637 | 5 | 81914498 | 84824103 |
| 9638 | 5 | 81914498 | 84824203 |
| 9639 | 5 | 81914498 | 84824816 |
| 9640 | 5 | 81914498 | 84825422 |
| 9641 | 5 | 81914498 | 84825763 |
| 9642 | 5 | 81914498 | 84825942 |
| 9643 | 5 | 81914498 | 84843411 |
| 9644 | 5 | 81914498 | 84936441 |
| 9645 | 5 | 81914498 | 84936493 |
| 9646 | 5 | 81914498 | 84943705 |
| 9647 | 5 | 81914498 | 169454950 |
| 9648 | 5 | 81914498 | 181522829 |
| 9649 | 5 | 81914498 | 204759879 |
| 9650 | 5 | 81914498 | 209874191 |
| 9651 | 5 | 81950191 | 81265937 |
| 9652 | 5 | 81950191 | 81954891 |
| 9653 | 5 | 81950191 | 81985250 |
| 9654 | 5 | 81950191 | 82083752 |
| 9655 | 5 | 81950191 | 82101253 |
| 9656 | 5 | 81950191 | 82143124 |
| 9657 | 5 | 81950191 | 82236318 |
| 9658 | 5 | 81950191 | 82325587 |
| 9659 | 5 | 81950191 | 82427210 |
| 9660 | 5 | 81950191 | 82431853 |
| 9661 | 5 | 81950191 | 82446714 |
| 9662 | 5 | 81950191 | 82446794 |
| 9663 | 5 | 81950191 | 82551111 |
| 9664 | 5 | 81950191 | 82552090 |
| 9665 | 5 | 81950191 | 82555641 |
| 9666 | 5 | 81950191 | 82555670 |
| 9667 | 5 | 81950191 | 82556511 |
| 9668 | 5 | 81950191 | 82559047 |
| 9669 | 5 | 81950191 | 82561535 |
| 9670 | 5 | 81950191 | 82610100 |

TABLE 1-continued

Examples of chromosomal segments associated with increased fertility in maize.

| Chromosomal Segment | Chr. | Boundary 1 | Boundary 2 |
|---|---|---|---|
| 9671 | 5 | 81950191 | 82676822 |
| 9672 | 5 | 81950191 | 82676901 |
| 9673 | 5 | 81950191 | 82883691 |
| 9674 | 5 | 81950191 | 82954942 |
| 9675 | 5 | 81950191 | 82971688 |
| 9676 | 5 | 81950191 | 83023965 |
| 9677 | 5 | 81950191 | 83094205 |
| 9678 | 5 | 81950191 | 83146355 |
| 9679 | 5 | 81950191 | 83280630 |
| 9680 | 5 | 81950191 | 83281412 |
| 9681 | 5 | 81950191 | 83400242 |
| 9682 | 5 | 81950191 | 83405797 |
| 9683 | 5 | 81950191 | 83437132 |
| 9684 | 5 | 81950191 | 83522252 |
| 9685 | 5 | 81950191 | 83560095 |
| 9686 | 5 | 81950191 | 83560204 |
| 9687 | 5 | 81950191 | 83572400 |
| 9688 | 5 | 81950191 | 83607661 |
| 9689 | 5 | 81950191 | 83745342 |
| 9690 | 5 | 81950191 | 83861275 |
| 9691 | 5 | 81950191 | 83861633 |
| 9692 | 5 | 81950191 | 83865653 |
| 9693 | 5 | 81950191 | 83865914 |
| 9694 | 5 | 81950191 | 83865920 |
| 9695 | 5 | 81950191 | 83868010 |
| 9696 | 5 | 81950191 | 84019752 |
| 9697 | 5 | 81950191 | 84065912 |
| 9698 | 5 | 81950191 | 84086632 |
| 9699 | 5 | 81950191 | 84089603 |
| 9700 | 5 | 81950191 | 84104814 |
| 9701 | 5 | 81950191 | 84105175 |
| 9702 | 5 | 81950191 | 84251635 |
| 9703 | 5 | 81950191 | 84252180 |
| 9704 | 5 | 81950191 | 84253030 |
| 9705 | 5 | 81950191 | 84254208 |
| 9706 | 5 | 81950191 | 84314930 |
| 9707 | 5 | 81950191 | 84340523 |
| 9708 | 5 | 81950191 | 84516340 |
| 9709 | 5 | 81950191 | 84706916 |
| 9710 | 5 | 81950191 | 84799488 |
| 9711 | 5 | 81950191 | 84801081 |
| 9712 | 5 | 81950191 | 84824103 |
| 9713 | 5 | 81950191 | 84824203 |
| 9714 | 5 | 81950191 | 84824816 |
| 9715 | 5 | 81950191 | 84825422 |
| 9716 | 5 | 81950191 | 84825763 |
| 9717 | 5 | 81950191 | 84825942 |
| 9718 | 5 | 81950191 | 84843411 |
| 9719 | 5 | 81950191 | 84936441 |
| 9720 | 5 | 81950191 | 84936493 |
| 9721 | 5 | 81950191 | 84943705 |
| 9722 | 5 | 81950191 | 169454950 |
| 9723 | 5 | 81950191 | 181522829 |
| 9724 | 5 | 81950191 | 204759879 |
| 9725 | 5 | 81950191 | 209874191 |
| 9726 | 5 | 81951639 | 81265937 |
| 9727 | 5 | 81951639 | 81954891 |
| 9728 | 5 | 81951639 | 81985250 |
| 9729 | 5 | 81951639 | 82083752 |
| 9730 | 5 | 81951639 | 82101253 |
| 9731 | 5 | 81951639 | 82143124 |
| 9732 | 5 | 81951639 | 82236318 |
| 9733 | 5 | 81951639 | 82325587 |
| 9734 | 5 | 81951639 | 82427210 |
| 9735 | 5 | 81951639 | 82431853 |
| 9736 | 5 | 81951639 | 82446714 |
| 9737 | 5 | 81951639 | 82446794 |
| 9738 | 5 | 81951639 | 82551111 |
| 9739 | 5 | 81951639 | 82552090 |
| 9740 | 5 | 81951639 | 82555641 |
| 9741 | 5 | 81951639 | 82555670 |
| 9742 | 5 | 81951639 | 82556511 |
| 9743 | 5 | 81951639 | 82559047 |
| 9744 | 5 | 81951639 | 82561535 |
| 9745 | 5 | 81951639 | 82610100 |
| 9746 | 5 | 81951639 | 82676822 |
| 9747 | 5 | 81951639 | 82676901 |
| 9748 | 5 | 81951639 | 82883691 |
| 9749 | 5 | 81951639 | 82954942 |
| 9750 | 5 | 81951639 | 82971688 |
| 9751 | 5 | 81951639 | 83023965 |
| 9752 | 5 | 81951639 | 83094205 |
| 9753 | 5 | 81951639 | 83146355 |
| 9754 | 5 | 81951639 | 83280630 |
| 9755 | 5 | 81951639 | 83281412 |
| 9756 | 5 | 81951639 | 83400242 |
| 9757 | 5 | 81951639 | 83405797 |
| 9758 | 5 | 81951639 | 83437132 |
| 9759 | 5 | 81951639 | 83522252 |
| 9760 | 5 | 81951639 | 83560095 |
| 9761 | 5 | 81951639 | 83560204 |
| 9762 | 5 | 81951639 | 83572400 |
| 9763 | 5 | 81951639 | 83607661 |
| 9764 | 5 | 81951639 | 83745342 |
| 9765 | 5 | 81951639 | 83861275 |
| 9766 | 5 | 81951639 | 83861633 |
| 9767 | 5 | 81951639 | 83865653 |
| 9768 | 5 | 81951639 | 83865914 |
| 9769 | 5 | 81951639 | 83865920 |
| 9770 | 5 | 81951639 | 83868010 |
| 9771 | 5 | 81951639 | 84019752 |
| 9772 | 5 | 81951639 | 84065912 |
| 9773 | 5 | 81951639 | 84086632 |
| 9774 | 5 | 81951639 | 84089603 |
| 9775 | 5 | 81951639 | 84104814 |
| 9776 | 5 | 81951639 | 84105175 |
| 9777 | 5 | 81951639 | 84251635 |
| 9778 | 5 | 81951639 | 84252180 |
| 9779 | 5 | 81951639 | 84253030 |
| 9780 | 5 | 81951639 | 84254208 |
| 9781 | 5 | 81951639 | 84314930 |
| 9782 | 5 | 81951639 | 84340523 |
| 9783 | 5 | 81951639 | 84516340 |
| 9784 | 5 | 81951639 | 84706916 |
| 9785 | 5 | 81951639 | 84799488 |
| 9786 | 5 | 81951639 | 84801081 |
| 9787 | 5 | 81951639 | 84824103 |
| 9788 | 5 | 81951639 | 84824203 |
| 9789 | 5 | 81951639 | 84824816 |
| 9790 | 5 | 81951639 | 84825422 |
| 9791 | 5 | 81951639 | 84825763 |
| 9792 | 5 | 81951639 | 84825942 |
| 9793 | 5 | 81951639 | 84843411 |
| 9794 | 5 | 81951639 | 84936441 |
| 9795 | 5 | 81951639 | 84936493 |
| 9796 | 5 | 81951639 | 84943705 |
| 9797 | 5 | 81951639 | 169454950 |
| 9798 | 5 | 81951639 | 181522829 |
| 9799 | 5 | 81951639 | 204759879 |
| 9800 | 5 | 81951639 | 209874191 |
| 9801 | 5 | 81984901 | 81265937 |
| 9802 | 5 | 81984901 | 81985250 |
| 9803 | 5 | 81984901 | 82083752 |
| 9804 | 5 | 81984901 | 82101253 |
| 9805 | 5 | 81984901 | 82143124 |
| 9806 | 5 | 81984901 | 82236318 |
| 9807 | 5 | 81984901 | 82325587 |
| 9808 | 5 | 81984901 | 82427210 |
| 9809 | 5 | 81984901 | 82431853 |
| 9810 | 5 | 81984901 | 82446714 |
| 9811 | 5 | 81984901 | 82446794 |
| 9812 | 5 | 81984901 | 82551111 |
| 9813 | 5 | 81984901 | 82552090 |
| 9814 | 5 | 81984901 | 82555641 |
| 9815 | 5 | 81984901 | 82555670 |
| 9816 | 5 | 81984901 | 82556511 |
| 9817 | 5 | 81984901 | 82559047 |
| 9818 | 5 | 81984901 | 82561535 |

TABLE 1-continued

Examples of chromosomal segments associated with increased fertility in maize.

| Chromosomal Segment | Chr. | Boundary 1 | Boundary 2 |
|---|---|---|---|
| 9819 | 5 | 81984901 | 82610100 |
| 9820 | 5 | 81984901 | 82676822 |
| 9821 | 5 | 81984901 | 82676901 |
| 9822 | 5 | 81984901 | 82883691 |
| 9823 | 5 | 81984901 | 82954942 |
| 9824 | 5 | 81984901 | 82971688 |
| 9825 | 5 | 81984901 | 83023965 |
| 9826 | 5 | 81984901 | 83094205 |
| 9827 | 5 | 81984901 | 83146355 |
| 9828 | 5 | 81984901 | 83280630 |
| 9829 | 5 | 81984901 | 83281412 |
| 9830 | 5 | 81984901 | 83400242 |
| 9831 | 5 | 81984901 | 83405797 |
| 9832 | 5 | 81984901 | 83437132 |
| 9833 | 5 | 81984901 | 83522252 |
| 9834 | 5 | 81984901 | 83560095 |
| 9835 | 5 | 81984901 | 83560204 |
| 9836 | 5 | 81984901 | 83572400 |
| 9837 | 5 | 81984901 | 83607661 |
| 9838 | 5 | 81984901 | 83745342 |
| 9839 | 5 | 81984901 | 83861275 |
| 9840 | 5 | 81984901 | 83861633 |
| 9841 | 5 | 81984901 | 83865653 |
| 9842 | 5 | 81984901 | 83865914 |
| 9843 | 5 | 81984901 | 83865920 |
| 9844 | 5 | 81984901 | 83868010 |
| 9845 | 5 | 81984901 | 84019752 |
| 9846 | 5 | 81984901 | 84065912 |
| 9847 | 5 | 81984901 | 84086632 |
| 9848 | 5 | 81984901 | 84089603 |
| 9849 | 5 | 81984901 | 84104814 |
| 9850 | 5 | 81984901 | 84105175 |
| 9851 | 5 | 81984901 | 84251635 |
| 9852 | 5 | 81984901 | 84252180 |
| 9853 | 5 | 81984901 | 84253030 |
| 9854 | 5 | 81984901 | 84254208 |
| 9855 | 5 | 81984901 | 84314930 |
| 9856 | 5 | 81984901 | 84340523 |
| 9857 | 5 | 81984901 | 84516340 |
| 9858 | 5 | 81984901 | 84706916 |
| 9859 | 5 | 81984901 | 84799488 |
| 9860 | 5 | 81984901 | 84801081 |
| 9861 | 5 | 81984901 | 84824103 |
| 9862 | 5 | 81984901 | 84824203 |
| 9863 | 5 | 81984901 | 84824816 |
| 9864 | 5 | 81984901 | 84825422 |
| 9865 | 5 | 81984901 | 84825763 |
| 9866 | 5 | 81984901 | 84825942 |
| 9867 | 5 | 81984901 | 84843411 |
| 9868 | 5 | 81984901 | 84936441 |
| 9869 | 5 | 81984901 | 84936493 |
| 9870 | 5 | 81984901 | 84943705 |
| 9871 | 5 | 81984901 | 169454950 |
| 9872 | 5 | 81984901 | 181522829 |
| 9873 | 5 | 81984901 | 204759879 |
| 9874 | 5 | 81984901 | 209874191 |
| 9875 | 5 | 82083639 | 81265937 |
| 9876 | 5 | 82083639 | 82083752 |
| 9877 | 5 | 82083639 | 82101253 |
| 9878 | 5 | 82083639 | 82143124 |
| 9879 | 5 | 82083639 | 82236318 |
| 9880 | 5 | 82083639 | 82325587 |
| 9881 | 5 | 82083639 | 82427210 |
| 9882 | 5 | 82083639 | 82431853 |
| 9883 | 5 | 82083639 | 82446714 |
| 9884 | 5 | 82083639 | 82446794 |
| 9885 | 5 | 82083639 | 82551111 |
| 9886 | 5 | 82083639 | 82552090 |
| 9887 | 5 | 82083639 | 82555641 |
| 9888 | 5 | 82083639 | 82555670 |
| 9889 | 5 | 82083639 | 82556511 |
| 9890 | 5 | 82083639 | 82559047 |
| 9891 | 5 | 82083639 | 82561535 |
| 9892 | 5 | 82083639 | 82610100 |
| 9893 | 5 | 82083639 | 82676822 |
| 9894 | 5 | 82083639 | 82676901 |
| 9895 | 5 | 82083639 | 82883691 |
| 9896 | 5 | 82083639 | 82954942 |
| 9897 | 5 | 82083639 | 82971688 |
| 9898 | 5 | 82083639 | 83023965 |
| 9899 | 5 | 82083639 | 83094205 |
| 9900 | 5 | 82083639 | 83146355 |
| 9901 | 5 | 82083639 | 83280630 |
| 9902 | 5 | 82083639 | 83281412 |
| 9903 | 5 | 82083639 | 83400242 |
| 9904 | 5 | 82083639 | 83405797 |
| 9905 | 5 | 82083639 | 83437132 |
| 9906 | 5 | 82083639 | 83522252 |
| 9907 | 5 | 82083639 | 83560095 |
| 9908 | 5 | 82083639 | 83560204 |
| 9909 | 5 | 82083639 | 83572400 |
| 9910 | 5 | 82083639 | 83607661 |
| 9911 | 5 | 82083639 | 83745342 |
| 9912 | 5 | 82083639 | 83861275 |
| 9913 | 5 | 82083639 | 83861633 |
| 9914 | 5 | 82083639 | 83865653 |
| 9915 | 5 | 82083639 | 83865914 |
| 9916 | 5 | 82083639 | 83865920 |
| 9917 | 5 | 82083639 | 83868010 |
| 9918 | 5 | 82083639 | 84019752 |
| 9919 | 5 | 82083639 | 84065912 |
| 9920 | 5 | 82083639 | 84086632 |
| 9921 | 5 | 82083639 | 84089603 |
| 9922 | 5 | 82083639 | 84104814 |
| 9923 | 5 | 82083639 | 84105175 |
| 9924 | 5 | 82083639 | 84251635 |
| 9925 | 5 | 82083639 | 84252180 |
| 9926 | 5 | 82083639 | 84253030 |
| 9927 | 5 | 82083639 | 84254208 |
| 9928 | 5 | 82083639 | 84314930 |
| 9929 | 5 | 82083639 | 84340523 |
| 9930 | 5 | 82083639 | 84516340 |
| 9931 | 5 | 82083639 | 84706916 |
| 9932 | 5 | 82083639 | 84799488 |
| 9933 | 5 | 82083639 | 84801081 |
| 9934 | 5 | 82083639 | 84824103 |
| 9935 | 5 | 82083639 | 84824203 |
| 9936 | 5 | 82083639 | 84824816 |
| 9937 | 5 | 82083639 | 84825422 |
| 9938 | 5 | 82083639 | 84825763 |
| 9939 | 5 | 82083639 | 84825942 |
| 9940 | 5 | 82083639 | 84843411 |
| 9941 | 5 | 82083639 | 84936441 |
| 9942 | 5 | 82083639 | 84936493 |
| 9943 | 5 | 82083639 | 84943705 |
| 9944 | 5 | 82083639 | 169454950 |
| 9945 | 5 | 82083639 | 181522829 |
| 9946 | 5 | 82083639 | 204759879 |
| 9947 | 5 | 82083639 | 209874191 |
| 9948 | 5 | 82083752 | 81265937 |
| 9949 | 5 | 82083752 | 82137780 |
| 9950 | 5 | 82083752 | 82143124 |
| 9951 | 5 | 82083752 | 82236318 |
| 9952 | 5 | 82083752 | 82325587 |
| 9953 | 5 | 82083752 | 82427210 |
| 9954 | 5 | 82083752 | 82431853 |
| 9955 | 5 | 82083752 | 82446714 |
| 9956 | 5 | 82083752 | 82446794 |
| 9957 | 5 | 82083752 | 82551111 |
| 9958 | 5 | 82083752 | 82552090 |
| 9959 | 5 | 82083752 | 82555641 |
| 9960 | 5 | 82083752 | 82555670 |
| 9961 | 5 | 82083752 | 82556511 |
| 9962 | 5 | 82083752 | 82559047 |
| 9963 | 5 | 82083752 | 82561535 |
| 9964 | 5 | 82083752 | 82610100 |
| 9965 | 5 | 82083752 | 82676822 |
| 9966 | 5 | 82083752 | 82676901 |

TABLE 1-continued

Examples of chromosomal segments associated with increased fertility in maize.

| Chromosomal Segment | Chr. | Boundary 1 | Boundary 2 |
|---|---|---|---|
| 9967 | 5 | 82083752 | 82883691 |
| 9968 | 5 | 82083752 | 82954942 |
| 9969 | 5 | 82083752 | 82971688 |
| 9970 | 5 | 82083752 | 83023965 |
| 9971 | 5 | 82083752 | 83094205 |
| 9972 | 5 | 82083752 | 83146355 |
| 9973 | 5 | 82083752 | 83280630 |
| 9974 | 5 | 82083752 | 83281412 |
| 9975 | 5 | 82083752 | 83400242 |
| 9976 | 5 | 82083752 | 83405797 |
| 9977 | 5 | 82083752 | 83437132 |
| 9978 | 5 | 82083752 | 83522252 |
| 9979 | 5 | 82083752 | 83560095 |
| 9980 | 5 | 82083752 | 83560204 |
| 9981 | 5 | 82083752 | 83572400 |
| 9982 | 5 | 82083752 | 83607661 |
| 9983 | 5 | 82083752 | 83745342 |
| 9984 | 5 | 82083752 | 83861275 |
| 9985 | 5 | 82083752 | 83861633 |
| 9986 | 5 | 82083752 | 83865653 |
| 9987 | 5 | 82083752 | 83865914 |
| 9988 | 5 | 82083752 | 83865920 |
| 9989 | 5 | 82083752 | 83868010 |
| 9990 | 5 | 82083752 | 84019752 |
| 9991 | 5 | 82083752 | 84065912 |
| 9992 | 5 | 82083752 | 84086632 |
| 9993 | 5 | 82083752 | 84089603 |
| 9994 | 5 | 82083752 | 84104814 |
| 9995 | 5 | 82083752 | 84105175 |
| 9996 | 5 | 82083752 | 84251635 |
| 9997 | 5 | 82083752 | 84252180 |
| 9998 | 5 | 82083752 | 84253030 |
| 9999 | 5 | 82083752 | 84254208 |
| 10000 | 5 | 82083752 | 84314930 |
| 10001 | 5 | 82083752 | 84340523 |
| 10002 | 5 | 82083752 | 84516340 |
| 10003 | 5 | 82083752 | 84706916 |
| 10004 | 5 | 82083752 | 84799488 |
| 10005 | 5 | 82083752 | 84801081 |
| 10006 | 5 | 82083752 | 84824103 |
| 10007 | 5 | 82083752 | 84824203 |
| 10008 | 5 | 82083752 | 84824816 |
| 10009 | 5 | 82083752 | 84825422 |
| 10010 | 5 | 82083752 | 84825763 |
| 10011 | 5 | 82083752 | 84825942 |
| 10012 | 5 | 82083752 | 84843411 |
| 10013 | 5 | 82083752 | 84936441 |
| 10014 | 5 | 82083752 | 84936493 |
| 10015 | 5 | 82083752 | 84943705 |
| 10016 | 5 | 82083752 | 169454950 |
| 10017 | 5 | 82083752 | 181522829 |
| 10018 | 5 | 82083752 | 204759879 |
| 10019 | 5 | 82083752 | 209874191 |
| 10020 | 5 | 82137780 | 81265937 |
| 10021 | 5 | 82137780 | 82143124 |
| 10022 | 5 | 82137780 | 82236318 |
| 10023 | 5 | 82137780 | 82325587 |
| 10024 | 5 | 82137780 | 82427210 |
| 10025 | 5 | 82137780 | 82431853 |
| 10026 | 5 | 82137780 | 82446714 |
| 10027 | 5 | 82137780 | 82446794 |
| 10028 | 5 | 82137780 | 82551111 |
| 10029 | 5 | 82137780 | 82552090 |
| 10030 | 5 | 82137780 | 82555641 |
| 10031 | 5 | 82137780 | 82555670 |
| 10032 | 5 | 82137780 | 82556511 |
| 10033 | 5 | 82137780 | 82559047 |
| 10034 | 5 | 82137780 | 82561535 |
| 10035 | 5 | 82137780 | 82610100 |
| 10036 | 5 | 82137780 | 82676822 |
| 10037 | 5 | 82137780 | 82676901 |
| 10038 | 5 | 82137780 | 82883691 |
| 10039 | 5 | 82137780 | 82954942 |
| 10040 | 5 | 82137780 | 82971688 |
| 10041 | 5 | 82137780 | 83023965 |
| 10042 | 5 | 82137780 | 83094205 |
| 10043 | 5 | 82137780 | 83146355 |
| 10044 | 5 | 82137780 | 83280630 |
| 10045 | 5 | 82137780 | 83281412 |
| 10046 | 5 | 82137780 | 83400242 |
| 10047 | 5 | 82137780 | 83405797 |
| 10048 | 5 | 82137780 | 83437132 |
| 10049 | 5 | 82137780 | 83522252 |
| 10050 | 5 | 82137780 | 83560095 |
| 10051 | 5 | 82137780 | 83560204 |
| 10052 | 5 | 82137780 | 83572400 |
| 10053 | 5 | 82137780 | 83607661 |
| 10054 | 5 | 82137780 | 83745342 |
| 10055 | 5 | 82137780 | 83861275 |
| 10056 | 5 | 82137780 | 83861633 |
| 10057 | 5 | 82137780 | 83865653 |
| 10058 | 5 | 82137780 | 83865914 |
| 10059 | 5 | 82137780 | 83865920 |
| 10060 | 5 | 82137780 | 83868010 |
| 10061 | 5 | 82137780 | 84019752 |
| 10062 | 5 | 82137780 | 84065912 |
| 10063 | 5 | 82137780 | 84086632 |
| 10064 | 5 | 82137780 | 84089603 |
| 10065 | 5 | 82137780 | 84104814 |
| 10066 | 5 | 82137780 | 84105175 |
| 10067 | 5 | 82137780 | 84251635 |
| 10068 | 5 | 82137780 | 84252180 |
| 10069 | 5 | 82137780 | 84253030 |
| 10070 | 5 | 82137780 | 84254208 |
| 10071 | 5 | 82137780 | 84314930 |
| 10072 | 5 | 82137780 | 84340523 |
| 10073 | 5 | 82137780 | 84516340 |
| 10074 | 5 | 82137780 | 84706916 |
| 10075 | 5 | 82137780 | 84799488 |
| 10076 | 5 | 82137780 | 84801081 |
| 10077 | 5 | 82137780 | 84824103 |
| 10078 | 5 | 82137780 | 84824203 |
| 10079 | 5 | 82137780 | 84824816 |
| 10080 | 5 | 82137780 | 84825422 |
| 10081 | 5 | 82137780 | 84825763 |
| 10082 | 5 | 82137780 | 84825942 |
| 10083 | 5 | 82137780 | 84843411 |
| 10084 | 5 | 82137780 | 84936441 |
| 10085 | 5 | 82137780 | 84936493 |
| 10086 | 5 | 82137780 | 84943705 |
| 10087 | 5 | 82137780 | 169454950 |
| 10088 | 5 | 82137780 | 181522829 |
| 10089 | 5 | 82137780 | 204759879 |
| 10090 | 5 | 82137780 | 209874191 |
| 10091 | 5 | 82139338 | 81265937 |
| 10092 | 5 | 82139338 | 82143124 |
| 10093 | 5 | 82139338 | 82236318 |
| 10094 | 5 | 82139338 | 82325587 |
| 10095 | 5 | 82139338 | 82427210 |
| 10096 | 5 | 82139338 | 82431853 |
| 10097 | 5 | 82139338 | 82446714 |
| 10098 | 5 | 82139338 | 82446794 |
| 10099 | 5 | 82139338 | 82551111 |
| 10100 | 5 | 82139338 | 82552090 |
| 10101 | 5 | 82139338 | 82555641 |
| 10102 | 5 | 82139338 | 82555670 |
| 10103 | 5 | 82139338 | 82556511 |
| 10104 | 5 | 82139338 | 82559047 |
| 10105 | 5 | 82139338 | 82561535 |
| 10106 | 5 | 82139338 | 82610100 |
| 10107 | 5 | 82139338 | 82676822 |
| 10108 | 5 | 82139338 | 82676901 |
| 10109 | 5 | 82139338 | 82883691 |
| 10110 | 5 | 82139338 | 82954942 |
| 10111 | 5 | 82139338 | 82971688 |
| 10112 | 5 | 82139338 | 83023965 |
| 10113 | 5 | 82139338 | 83094205 |
| 10114 | 5 | 82139338 | 83146355 |

TABLE 1-continued

Examples of chromosomal segments associated with increased fertility in maize.

| Chromosomal Segment | Chr. | Boundary 1 | Boundary 2 |
|---|---|---|---|
| 10115 | 5 | 82139338 | 83280630 |
| 10116 | 5 | 82139338 | 83281412 |
| 10117 | 5 | 82139338 | 83400242 |
| 10118 | 5 | 82139338 | 83405797 |
| 10119 | 5 | 82139338 | 83437132 |
| 10120 | 5 | 82139338 | 83522252 |
| 10121 | 5 | 82139338 | 83560095 |
| 10122 | 5 | 82139338 | 83560204 |
| 10123 | 5 | 82139338 | 83572400 |
| 10124 | 5 | 82139338 | 83607661 |
| 10125 | 5 | 82139338 | 83745342 |
| 10126 | 5 | 82139338 | 83861275 |
| 10127 | 5 | 82139338 | 83861633 |
| 10128 | 5 | 82139338 | 83865653 |
| 10129 | 5 | 82139338 | 83865914 |
| 10130 | 5 | 82139338 | 83865920 |
| 10131 | 5 | 82139338 | 83868010 |
| 10132 | 5 | 82139338 | 84019752 |
| 10133 | 5 | 82139338 | 84065912 |
| 10134 | 5 | 82139338 | 84086632 |
| 10135 | 5 | 82139338 | 84089603 |
| 10136 | 5 | 82139338 | 84104814 |
| 10137 | 5 | 82139338 | 84105175 |
| 10138 | 5 | 82139338 | 84251635 |
| 10139 | 5 | 82139338 | 84252180 |
| 10140 | 5 | 82139338 | 84253030 |
| 10141 | 5 | 82139338 | 84254208 |
| 10142 | 5 | 82139338 | 84314930 |
| 10143 | 5 | 82139338 | 84340523 |
| 10144 | 5 | 82139338 | 84516340 |
| 10145 | 5 | 82139338 | 84706916 |
| 10146 | 5 | 82139338 | 84799488 |
| 10147 | 5 | 82139338 | 84801081 |
| 10148 | 5 | 82139338 | 84824103 |
| 10149 | 5 | 82139338 | 84824203 |
| 10150 | 5 | 82139338 | 84824816 |
| 10151 | 5 | 82139338 | 84825422 |
| 10152 | 5 | 82139338 | 84825763 |
| 10153 | 5 | 82139338 | 84825942 |
| 10154 | 5 | 82139338 | 84843411 |
| 10155 | 5 | 82139338 | 84936441 |
| 10156 | 5 | 82139338 | 84936493 |
| 10157 | 5 | 82139338 | 84943705 |
| 10158 | 5 | 82139338 | 169454950 |
| 10159 | 5 | 82139338 | 181522829 |
| 10160 | 5 | 82139338 | 204759879 |
| 10161 | 5 | 82139338 | 209874191 |
| 10162 | 5 | 82234311 | 81265937 |
| 10163 | 5 | 82234311 | 82236318 |
| 10164 | 5 | 82234311 | 82325587 |
| 10165 | 5 | 82234311 | 82427210 |
| 10166 | 5 | 82234311 | 82431853 |
| 10167 | 5 | 82234311 | 82446714 |
| 10168 | 5 | 82234311 | 82446794 |
| 10169 | 5 | 82234311 | 82551111 |
| 10170 | 5 | 82234311 | 82552090 |
| 10171 | 5 | 82234311 | 82555641 |
| 10172 | 5 | 82234311 | 82555670 |
| 10173 | 5 | 82234311 | 82556511 |
| 10174 | 5 | 82234311 | 82559047 |
| 10175 | 5 | 82234311 | 82561535 |
| 10176 | 5 | 82234311 | 82610100 |
| 10177 | 5 | 82234311 | 82676822 |
| 10178 | 5 | 82234311 | 82676901 |
| 10179 | 5 | 82234311 | 82883691 |
| 10180 | 5 | 82234311 | 82954942 |
| 10181 | 5 | 82234311 | 82971688 |
| 10182 | 5 | 82234311 | 83023965 |
| 10183 | 5 | 82234311 | 83094205 |
| 10184 | 5 | 82234311 | 83146355 |
| 10185 | 5 | 82234311 | 83280630 |
| 10186 | 5 | 82234311 | 83281412 |
| 10187 | 5 | 82234311 | 83400242 |
| 10188 | 5 | 82234311 | 83405797 |
| 10189 | 5 | 82234311 | 83437132 |
| 10190 | 5 | 82234311 | 83522252 |
| 10191 | 5 | 82234311 | 83560095 |
| 10192 | 5 | 82234311 | 83560204 |
| 10193 | 5 | 82234311 | 83572400 |
| 10194 | 5 | 82234311 | 83607661 |
| 10195 | 5 | 82234311 | 83745342 |
| 10196 | 5 | 82234311 | 83861275 |
| 10197 | 5 | 82234311 | 83861633 |
| 10198 | 5 | 82234311 | 83865653 |
| 10199 | 5 | 82234311 | 83865914 |
| 10200 | 5 | 82234311 | 83865920 |
| 10201 | 5 | 82234311 | 83868010 |
| 10202 | 5 | 82234311 | 84019752 |
| 10203 | 5 | 82234311 | 84065912 |
| 10204 | 5 | 82234311 | 84086632 |
| 10205 | 5 | 82234311 | 84089603 |
| 10206 | 5 | 82234311 | 84104814 |
| 10207 | 5 | 82234311 | 84105175 |
| 10208 | 5 | 82234311 | 84251635 |
| 10209 | 5 | 82234311 | 84252180 |
| 10210 | 5 | 82234311 | 84253030 |
| 10211 | 5 | 82234311 | 84254208 |
| 10212 | 5 | 82234311 | 84314930 |
| 10213 | 5 | 82234311 | 84340523 |
| 10214 | 5 | 82234311 | 84516340 |
| 10215 | 5 | 82234311 | 84706916 |
| 10216 | 5 | 82234311 | 84799488 |
| 10217 | 5 | 82234311 | 84801081 |
| 10218 | 5 | 82234311 | 84824103 |
| 10219 | 5 | 82234311 | 84824203 |
| 10220 | 5 | 82234311 | 84824816 |
| 10221 | 5 | 82234311 | 84825422 |
| 10222 | 5 | 82234311 | 84825763 |
| 10223 | 5 | 82234311 | 84825942 |
| 10224 | 5 | 82234311 | 84843411 |
| 10225 | 5 | 82234311 | 84936441 |
| 10226 | 5 | 82234311 | 84936493 |
| 10227 | 5 | 82234311 | 84943705 |
| 10228 | 5 | 82234311 | 169454950 |
| 10229 | 5 | 82234311 | 181522829 |
| 10230 | 5 | 82234311 | 204759879 |
| 10231 | 5 | 82234311 | 209874191 |
| 10232 | 5 | 82236318 | 81265937 |
| 10233 | 5 | 82325587 | 82423451 |
| 10234 | 5 | 82325587 | 82427210 |
| 10235 | 5 | 82325587 | 82431853 |
| 10236 | 5 | 82325587 | 82446714 |
| 10237 | 5 | 82325587 | 82446794 |
| 10238 | 5 | 82325587 | 82551111 |
| 10239 | 5 | 82325587 | 82552090 |
| 10240 | 5 | 82325587 | 82555641 |
| 10241 | 5 | 82325587 | 82555670 |
| 10242 | 5 | 82325587 | 82556511 |
| 10243 | 5 | 82325587 | 82559047 |
| 10244 | 5 | 82325587 | 82561535 |
| 10245 | 5 | 82325587 | 82610100 |
| 10246 | 5 | 82325587 | 82676822 |
| 10247 | 5 | 82325587 | 82676901 |
| 10248 | 5 | 82325587 | 82883691 |
| 10249 | 5 | 82325587 | 82954942 |
| 10250 | 5 | 82325587 | 82971688 |
| 10251 | 5 | 82325587 | 83023965 |
| 10252 | 5 | 82325587 | 83094205 |
| 10253 | 5 | 82325587 | 83146355 |
| 10254 | 5 | 82325587 | 83280630 |
| 10255 | 5 | 82325587 | 83281412 |
| 10256 | 5 | 82325587 | 83400242 |
| 10257 | 5 | 82325587 | 83405797 |
| 10258 | 5 | 82325587 | 83437132 |
| 10259 | 5 | 82325587 | 83522252 |
| 10260 | 5 | 82325587 | 83560095 |
| 10261 | 5 | 82325587 | 83560204 |
| 10262 | 5 | 82325587 | 83572400 |

TABLE 1-continued

Examples of chromosomal segments associated with increased fertility in maize.

| Chromosomal Segment | Chr. | Boundary 1 | Boundary 2 |
|---|---|---|---|
| 10263 | 5 | 82325587 | 83607661 |
| 10264 | 5 | 82325587 | 83745342 |
| 10265 | 5 | 82325587 | 83861275 |
| 10266 | 5 | 82325587 | 83861633 |
| 10267 | 5 | 82325587 | 83865653 |
| 10268 | 5 | 82325587 | 83865914 |
| 10269 | 5 | 82325587 | 83865920 |
| 10270 | 5 | 82325587 | 83868010 |
| 10271 | 5 | 82325587 | 84019752 |
| 10272 | 5 | 82325587 | 84065912 |
| 10273 | 5 | 82325587 | 84086632 |
| 10274 | 5 | 82325587 | 84089603 |
| 10275 | 5 | 82325587 | 84104814 |
| 10276 | 5 | 82325587 | 84105175 |
| 10277 | 5 | 82325587 | 84251635 |
| 10278 | 5 | 82325587 | 84252180 |
| 10279 | 5 | 82325587 | 84253030 |
| 10280 | 5 | 82325587 | 84254208 |
| 10281 | 5 | 82325587 | 84314930 |
| 10282 | 5 | 82325587 | 84340523 |
| 10283 | 5 | 82325587 | 84516340 |
| 10284 | 5 | 82325587 | 84706916 |
| 10285 | 5 | 82325587 | 84799488 |
| 10286 | 5 | 82325587 | 84801081 |
| 10287 | 5 | 82325587 | 84824103 |
| 10288 | 5 | 82325587 | 84824203 |
| 10289 | 5 | 82325587 | 84824816 |
| 10290 | 5 | 82325587 | 84825422 |
| 10291 | 5 | 82325587 | 84825763 |
| 10292 | 5 | 82325587 | 84825942 |
| 10293 | 5 | 82325587 | 84843411 |
| 10294 | 5 | 82325587 | 84936441 |
| 10295 | 5 | 82325587 | 84936493 |
| 10296 | 5 | 82325587 | 84943705 |
| 10297 | 5 | 82325587 | 169454950 |
| 10298 | 5 | 82325587 | 181522829 |
| 10299 | 5 | 82325587 | 204759879 |
| 10300 | 5 | 82325587 | 209874191 |
| 10301 | 5 | 82423451 | 82427210 |
| 10302 | 5 | 82423451 | 82431853 |
| 10303 | 5 | 82423451 | 82446714 |
| 10304 | 5 | 82423451 | 82446794 |
| 10305 | 5 | 82423451 | 82551111 |
| 10306 | 5 | 82423451 | 82552090 |
| 10307 | 5 | 82423451 | 82555641 |
| 10308 | 5 | 82423451 | 82555670 |
| 10309 | 5 | 82423451 | 82556511 |
| 10310 | 5 | 82423451 | 82559047 |
| 10311 | 5 | 82423451 | 82561535 |
| 10312 | 5 | 82423451 | 82610100 |
| 10313 | 5 | 82423451 | 82676822 |
| 10314 | 5 | 82423451 | 82676901 |
| 10315 | 5 | 82423451 | 82883691 |
| 10316 | 5 | 82423451 | 82954942 |
| 10317 | 5 | 82423451 | 82971688 |
| 10318 | 5 | 82423451 | 83023965 |
| 10319 | 5 | 82423451 | 83094205 |
| 10320 | 5 | 82423451 | 83146355 |
| 10321 | 5 | 82423451 | 83280630 |
| 10322 | 5 | 82423451 | 83281412 |
| 10323 | 5 | 82423451 | 83400242 |
| 10324 | 5 | 82423451 | 83405797 |
| 10325 | 5 | 82423451 | 83437132 |
| 10326 | 5 | 82423451 | 83522252 |
| 10327 | 5 | 82423451 | 83560095 |
| 10328 | 5 | 82423451 | 83560204 |
| 10329 | 5 | 82423451 | 83572400 |
| 10330 | 5 | 82423451 | 83607661 |
| 10331 | 5 | 82423451 | 83745342 |
| 10332 | 5 | 82423451 | 83861275 |
| 10333 | 5 | 82423451 | 83861633 |
| 10334 | 5 | 82423451 | 83865653 |
| 10335 | 5 | 82423451 | 83865914 |
| 10336 | 5 | 82423451 | 83865920 |
| 10337 | 5 | 82423451 | 83868010 |
| 10338 | 5 | 82423451 | 84019752 |
| 10339 | 5 | 82423451 | 84065912 |
| 10340 | 5 | 82423451 | 84086632 |
| 10341 | 5 | 82423451 | 84089603 |
| 10342 | 5 | 82423451 | 84104814 |
| 10343 | 5 | 82423451 | 84105175 |
| 10344 | 5 | 82423451 | 84251635 |
| 10345 | 5 | 82423451 | 84252180 |
| 10346 | 5 | 82423451 | 84253030 |
| 10347 | 5 | 82423451 | 84254208 |
| 10348 | 5 | 82423451 | 84314930 |
| 10349 | 5 | 82423451 | 84340523 |
| 10350 | 5 | 82423451 | 84516340 |
| 10351 | 5 | 82423451 | 84706916 |
| 10352 | 5 | 82423451 | 84799488 |
| 10353 | 5 | 82423451 | 84801081 |
| 10354 | 5 | 82423451 | 84824103 |
| 10355 | 5 | 82423451 | 84824203 |
| 10356 | 5 | 82423451 | 84824816 |
| 10357 | 5 | 82423451 | 84825422 |
| 10358 | 5 | 82423451 | 84825763 |
| 10359 | 5 | 82423451 | 84825942 |
| 10360 | 5 | 82423451 | 84843411 |
| 10361 | 5 | 82423451 | 84936441 |
| 10362 | 5 | 82423451 | 84936493 |
| 10363 | 5 | 82423451 | 84943705 |
| 10364 | 5 | 82423451 | 169454950 |
| 10365 | 5 | 82423451 | 181522829 |
| 10366 | 5 | 82423451 | 204759879 |
| 10367 | 5 | 82423451 | 209874191 |
| 10368 | 5 | 82427780 | 82431853 |
| 10369 | 5 | 82427780 | 82446714 |
| 10370 | 5 | 82427780 | 82446794 |
| 10371 | 5 | 82427780 | 82551111 |
| 10372 | 5 | 82427780 | 82552090 |
| 10373 | 5 | 82427780 | 82555641 |
| 10374 | 5 | 82427780 | 82555670 |
| 10375 | 5 | 82427780 | 82556511 |
| 10376 | 5 | 82427780 | 82559047 |
| 10377 | 5 | 82427780 | 82561535 |
| 10378 | 5 | 82427780 | 82610100 |
| 10379 | 5 | 82427780 | 82676822 |
| 10380 | 5 | 82427780 | 82676901 |
| 10381 | 5 | 82427780 | 82883691 |
| 10382 | 5 | 82427780 | 82954942 |
| 10383 | 5 | 82427780 | 82971688 |
| 10384 | 5 | 82427780 | 83023965 |
| 10385 | 5 | 82427780 | 83094205 |
| 10386 | 5 | 82427780 | 83146355 |
| 10387 | 5 | 82427780 | 83280630 |
| 10388 | 5 | 82427780 | 83281412 |
| 10389 | 5 | 82427780 | 83400242 |
| 10390 | 5 | 82427780 | 83405797 |
| 10391 | 5 | 82427780 | 83437132 |
| 10392 | 5 | 82427780 | 83522252 |
| 10393 | 5 | 82427780 | 83560095 |
| 10394 | 5 | 82427780 | 83560204 |
| 10395 | 5 | 82427780 | 83572400 |
| 10396 | 5 | 82427780 | 83607661 |
| 10397 | 5 | 82427780 | 83745342 |
| 10398 | 5 | 82427780 | 83861275 |
| 10399 | 5 | 82427780 | 83861633 |
| 10400 | 5 | 82427780 | 83865653 |
| 10401 | 5 | 82427780 | 83865914 |
| 10402 | 5 | 82427780 | 83865920 |
| 10403 | 5 | 82427780 | 83868010 |
| 10404 | 5 | 82427780 | 84019752 |
| 10405 | 5 | 82427780 | 84065912 |
| 10406 | 5 | 82427780 | 84086632 |
| 10407 | 5 | 82427780 | 84089603 |
| 10408 | 5 | 82427780 | 84104814 |
| 10409 | 5 | 82427780 | 84105175 |
| 10410 | 5 | 82427780 | 84251635 |

TABLE 1-continued

Examples of chromosomal segments associated with increased fertility in maize.

| Chromosomal Segment | Chr. | Boundary 1 | Boundary 2 |
|---|---|---|---|
| 10411 | 5 | 82427780 | 84252180 |
| 10412 | 5 | 82427780 | 84253030 |
| 10413 | 5 | 82427780 | 84254208 |
| 10414 | 5 | 82427780 | 84314930 |
| 10415 | 5 | 82427780 | 84340523 |
| 10416 | 5 | 82427780 | 84516340 |
| 10417 | 5 | 82427780 | 84706916 |
| 10418 | 5 | 82427780 | 84799488 |
| 10419 | 5 | 82427780 | 84801081 |
| 10420 | 5 | 82427780 | 84824103 |
| 10421 | 5 | 82427780 | 84824203 |
| 10422 | 5 | 82427780 | 84824816 |
| 10423 | 5 | 82427780 | 84825422 |
| 10424 | 5 | 82427780 | 84825763 |
| 10425 | 5 | 82427780 | 84825942 |
| 10426 | 5 | 82427780 | 84843411 |
| 10427 | 5 | 82427780 | 84936441 |
| 10428 | 5 | 82427780 | 84936493 |
| 10429 | 5 | 82427780 | 84943705 |
| 10430 | 5 | 82427780 | 169454950 |
| 10431 | 5 | 82427780 | 181522829 |
| 10432 | 5 | 82427780 | 204759879 |
| 10433 | 5 | 82427780 | 209874191 |
| 10434 | 5 | 82443403 | 82446714 |
| 10435 | 5 | 82443403 | 82446794 |
| 10436 | 5 | 82443403 | 82551111 |
| 10437 | 5 | 82443403 | 82552090 |
| 10438 | 5 | 82443403 | 82555641 |
| 10439 | 5 | 82443403 | 82555670 |
| 10440 | 5 | 82443403 | 82556511 |
| 10441 | 5 | 82443403 | 82559047 |
| 10442 | 5 | 82443403 | 82561535 |
| 10443 | 5 | 82443403 | 82610100 |
| 10444 | 5 | 82443403 | 82676822 |
| 10445 | 5 | 82443403 | 82676901 |
| 10446 | 5 | 82443403 | 82883691 |
| 10447 | 5 | 82443403 | 82954942 |
| 10448 | 5 | 82443403 | 82971688 |
| 10449 | 5 | 82443403 | 83023965 |
| 10450 | 5 | 82443403 | 83094205 |
| 10451 | 5 | 82443403 | 83146355 |
| 10452 | 5 | 82443403 | 83280630 |
| 10453 | 5 | 82443403 | 83281412 |
| 10454 | 5 | 82443403 | 83400242 |
| 10455 | 5 | 82443403 | 83405797 |
| 10456 | 5 | 82443403 | 83437132 |
| 10457 | 5 | 82443403 | 83522252 |
| 10458 | 5 | 82443403 | 83560095 |
| 10459 | 5 | 82443403 | 83560204 |
| 10460 | 5 | 82443403 | 83572400 |
| 10461 | 5 | 82443403 | 83607661 |
| 10462 | 5 | 82443403 | 83745342 |
| 10463 | 5 | 82443403 | 83861275 |
| 10464 | 5 | 82443403 | 83861633 |
| 10465 | 5 | 82443403 | 83865653 |
| 10466 | 5 | 82443403 | 83865914 |
| 10467 | 5 | 82443403 | 83865920 |
| 10468 | 5 | 82443403 | 83868010 |
| 10469 | 5 | 82443403 | 84019752 |
| 10470 | 5 | 82443403 | 84065912 |
| 10471 | 5 | 82443403 | 84086632 |
| 10472 | 5 | 82443403 | 84089603 |
| 10473 | 5 | 82443403 | 84104814 |
| 10474 | 5 | 82443403 | 84105175 |
| 10475 | 5 | 82443403 | 84251635 |
| 10476 | 5 | 82443403 | 84252180 |
| 10477 | 5 | 82443403 | 84253030 |
| 10478 | 5 | 82443403 | 84254208 |
| 10479 | 5 | 82443403 | 84314930 |
| 10480 | 5 | 82443403 | 84340523 |
| 10481 | 5 | 82443403 | 84516340 |
| 10482 | 5 | 82443403 | 84706916 |
| 10483 | 5 | 82443403 | 84799488 |
| 10484 | 5 | 82443403 | 84801081 |
| 10485 | 5 | 82443403 | 84824103 |
| 10486 | 5 | 82443403 | 84824203 |
| 10487 | 5 | 82443403 | 84824816 |
| 10488 | 5 | 82443403 | 84825422 |
| 10489 | 5 | 82443403 | 84825763 |
| 10490 | 5 | 82443403 | 84825942 |
| 10491 | 5 | 82443403 | 84843411 |
| 10492 | 5 | 82443403 | 84936441 |
| 10493 | 5 | 82443403 | 84936493 |
| 10494 | 5 | 82443403 | 84943705 |
| 10495 | 5 | 82443403 | 169454950 |
| 10496 | 5 | 82443403 | 181522829 |
| 10497 | 5 | 82443403 | 204759879 |
| 10498 | 5 | 82443403 | 209874191 |
| 10499 | 5 | 82443815 | 82446714 |
| 10500 | 5 | 82443815 | 82446794 |
| 10501 | 5 | 82443815 | 82551111 |
| 10502 | 5 | 82443815 | 82552090 |
| 10503 | 5 | 82443815 | 82555641 |
| 10504 | 5 | 82443815 | 82555670 |
| 10505 | 5 | 82443815 | 82556511 |
| 10506 | 5 | 82443815 | 82559047 |
| 10507 | 5 | 82443815 | 82561535 |
| 10508 | 5 | 82443815 | 82610100 |
| 10509 | 5 | 82443815 | 82676822 |
| 10510 | 5 | 82443815 | 82676901 |
| 10511 | 5 | 82443815 | 82883691 |
| 10512 | 5 | 82443815 | 82954942 |
| 10513 | 5 | 82443815 | 82971688 |
| 10514 | 5 | 82443815 | 83023965 |
| 10515 | 5 | 82443815 | 83094205 |
| 10516 | 5 | 82443815 | 83146355 |
| 10517 | 5 | 82443815 | 83280630 |
| 10518 | 5 | 82443815 | 83281412 |
| 10519 | 5 | 82443815 | 83400242 |
| 10520 | 5 | 82443815 | 83405797 |
| 10521 | 5 | 82443815 | 83437132 |
| 10522 | 5 | 82443815 | 83522252 |
| 10523 | 5 | 82443815 | 83560095 |
| 10524 | 5 | 82443815 | 83560204 |
| 10525 | 5 | 82443815 | 83572400 |
| 10526 | 5 | 82443815 | 83607661 |
| 10527 | 5 | 82443815 | 83745342 |
| 10528 | 5 | 82443815 | 83861275 |
| 10529 | 5 | 82443815 | 83861633 |
| 10530 | 5 | 82443815 | 83865653 |
| 10531 | 5 | 82443815 | 83865914 |
| 10532 | 5 | 82443815 | 83865920 |
| 10533 | 5 | 82443815 | 83868010 |
| 10534 | 5 | 82443815 | 84019752 |
| 10535 | 5 | 82443815 | 84065912 |
| 10536 | 5 | 82443815 | 84086632 |
| 10537 | 5 | 82443815 | 84089603 |
| 10538 | 5 | 82443815 | 84104814 |
| 10539 | 5 | 82443815 | 84105175 |
| 10540 | 5 | 82443815 | 84251635 |
| 10541 | 5 | 82443815 | 84252180 |
| 10542 | 5 | 82443815 | 84253030 |
| 10543 | 5 | 82443815 | 84254208 |
| 10544 | 5 | 82443815 | 84314930 |
| 10545 | 5 | 82443815 | 84340523 |
| 10546 | 5 | 82443815 | 84516340 |
| 10547 | 5 | 82443815 | 84706916 |
| 10548 | 5 | 82443815 | 84799488 |
| 10549 | 5 | 82443815 | 84801081 |
| 10550 | 5 | 82443815 | 84824103 |
| 10551 | 5 | 82443815 | 84824203 |
| 10552 | 5 | 82443815 | 84824816 |
| 10553 | 5 | 82443815 | 84825422 |
| 10554 | 5 | 82443815 | 84825763 |
| 10555 | 5 | 82443815 | 84825942 |
| 10556 | 5 | 82443815 | 84843411 |
| 10557 | 5 | 82443815 | 84936441 |
| 10558 | 5 | 82443815 | 84936493 |

TABLE 1-continued

Examples of chromosomal segments associated with increased fertility in maize.

| Chromosomal Segment | Chr. | Boundary 1 | Boundary 2 |
|---|---|---|---|
| 10559 | 5 | 82443815 | 84943705 |
| 10560 | 5 | 82443815 | 169454950 |
| 10561 | 5 | 82443815 | 181522829 |
| 10562 | 5 | 82443815 | 204759879 |
| 10563 | 5 | 82443815 | 209874191 |
| 10564 | 5 | 82443856 | 82446714 |
| 10565 | 5 | 82443856 | 82446794 |
| 10566 | 5 | 82443856 | 82551111 |
| 10567 | 5 | 82443856 | 82552090 |
| 10568 | 5 | 82443856 | 82555641 |
| 10569 | 5 | 82443856 | 82555670 |
| 10570 | 5 | 82443856 | 82556511 |
| 10571 | 5 | 82443856 | 82559047 |
| 10572 | 5 | 82443856 | 82561535 |
| 10573 | 5 | 82443856 | 82610100 |
| 10574 | 5 | 82443856 | 82676822 |
| 10575 | 5 | 82443856 | 82676901 |
| 10576 | 5 | 82443856 | 82883691 |
| 10577 | 5 | 82443856 | 82954942 |
| 10578 | 5 | 82443856 | 82971688 |
| 10579 | 5 | 82443856 | 83023965 |
| 10580 | 5 | 82443856 | 83094205 |
| 10581 | 5 | 82443856 | 83146355 |
| 10582 | 5 | 82443856 | 83280630 |
| 10583 | 5 | 82443856 | 83281412 |
| 10584 | 5 | 82443856 | 83400242 |
| 10585 | 5 | 82443856 | 83405797 |
| 10586 | 5 | 82443856 | 83437132 |
| 10587 | 5 | 82443856 | 83522252 |
| 10588 | 5 | 82443856 | 83560095 |
| 10589 | 5 | 82443856 | 83560204 |
| 10590 | 5 | 82443856 | 83572400 |
| 10591 | 5 | 82443856 | 83607661 |
| 10592 | 5 | 82443856 | 83745342 |
| 10593 | 5 | 82443856 | 83861275 |
| 10594 | 5 | 82443856 | 83861633 |
| 10595 | 5 | 82443856 | 83865653 |
| 10596 | 5 | 82443856 | 83865914 |
| 10597 | 5 | 82443856 | 83865920 |
| 10598 | 5 | 82443856 | 83868010 |
| 10599 | 5 | 82443856 | 84019752 |
| 10600 | 5 | 82443856 | 84065912 |
| 10601 | 5 | 82443856 | 84086632 |
| 10602 | 5 | 82443856 | 84089603 |
| 10603 | 5 | 82443856 | 84104814 |
| 10604 | 5 | 82443856 | 84105175 |
| 10605 | 5 | 82443856 | 84251635 |
| 10606 | 5 | 82443856 | 84252180 |
| 10607 | 5 | 82443856 | 84253030 |
| 10608 | 5 | 82443856 | 84254208 |
| 10609 | 5 | 82443856 | 84314930 |
| 10610 | 5 | 82443856 | 84340523 |
| 10611 | 5 | 82443856 | 84516340 |
| 10612 | 5 | 82443856 | 84706916 |
| 10613 | 5 | 82443856 | 84799488 |
| 10614 | 5 | 82443856 | 84801081 |
| 10615 | 5 | 82443856 | 84824103 |
| 10616 | 5 | 82443856 | 84824203 |
| 10617 | 5 | 82443856 | 84824816 |
| 10618 | 5 | 82443856 | 84825422 |
| 10619 | 5 | 82443856 | 84825763 |
| 10620 | 5 | 82443856 | 84825942 |
| 10621 | 5 | 82443856 | 84843411 |
| 10622 | 5 | 82443856 | 84936441 |
| 10623 | 5 | 82443856 | 84936493 |
| 10624 | 5 | 82443856 | 84943705 |
| 10625 | 5 | 82443856 | 169454950 |
| 10626 | 5 | 82443856 | 181522829 |
| 10627 | 5 | 82443856 | 204759879 |
| 10628 | 5 | 82443856 | 209874191 |
| 10629 | 5 | 82549227 | 82551111 |
| 10630 | 5 | 82549227 | 82552090 |
| 10631 | 5 | 82549227 | 82555641 |
| 10632 | 5 | 82549227 | 82555670 |
| 10633 | 5 | 82549227 | 82556511 |
| 10634 | 5 | 82549227 | 82559047 |
| 10635 | 5 | 82549227 | 82561535 |
| 10636 | 5 | 82549227 | 82610100 |
| 10637 | 5 | 82549227 | 82676822 |
| 10638 | 5 | 82549227 | 82676901 |
| 10639 | 5 | 82549227 | 82883691 |
| 10640 | 5 | 82549227 | 82954942 |
| 10641 | 5 | 82549227 | 82971688 |
| 10642 | 5 | 82549227 | 83023965 |
| 10643 | 5 | 82549227 | 83094205 |
| 10644 | 5 | 82549227 | 83146355 |
| 10645 | 5 | 82549227 | 83280630 |
| 10646 | 5 | 82549227 | 83281412 |
| 10647 | 5 | 82549227 | 83400242 |
| 10648 | 5 | 82549227 | 83405797 |
| 10649 | 5 | 82549227 | 83437132 |
| 10650 | 5 | 82549227 | 83522252 |
| 10651 | 5 | 82549227 | 83560095 |
| 10652 | 5 | 82549227 | 83560204 |
| 10653 | 5 | 82549227 | 83572400 |
| 10654 | 5 | 82549227 | 83607661 |
| 10655 | 5 | 82549227 | 83745342 |
| 10656 | 5 | 82549227 | 83861275 |
| 10657 | 5 | 82549227 | 83861633 |
| 10658 | 5 | 82549227 | 83865653 |
| 10659 | 5 | 82549227 | 83865914 |
| 10660 | 5 | 82549227 | 83865920 |
| 10661 | 5 | 82549227 | 83868010 |
| 10662 | 5 | 82549227 | 84019752 |
| 10663 | 5 | 82549227 | 84065912 |
| 10664 | 5 | 82549227 | 84086632 |
| 10665 | 5 | 82549227 | 84089603 |
| 10666 | 5 | 82549227 | 84104814 |
| 10667 | 5 | 82549227 | 84105175 |
| 10668 | 5 | 82549227 | 84251635 |
| 10669 | 5 | 82549227 | 84252180 |
| 10670 | 5 | 82549227 | 84253030 |
| 10671 | 5 | 82549227 | 84254208 |
| 10672 | 5 | 82549227 | 84314930 |
| 10673 | 5 | 82549227 | 84340523 |
| 10674 | 5 | 82549227 | 84516340 |
| 10675 | 5 | 82549227 | 84706916 |
| 10676 | 5 | 82549227 | 84799488 |
| 10677 | 5 | 82549227 | 84801081 |
| 10678 | 5 | 82549227 | 84824103 |
| 10679 | 5 | 82549227 | 84824203 |
| 10680 | 5 | 82549227 | 84824816 |
| 10681 | 5 | 82549227 | 84825422 |
| 10682 | 5 | 82549227 | 84825763 |
| 10683 | 5 | 82549227 | 84825942 |
| 10684 | 5 | 82549227 | 84843411 |
| 10685 | 5 | 82549227 | 84936441 |
| 10686 | 5 | 82549227 | 84936493 |
| 10687 | 5 | 82549227 | 84943705 |
| 10688 | 5 | 82549227 | 169454950 |
| 10689 | 5 | 82549227 | 181522829 |
| 10690 | 5 | 82549227 | 204759879 |
| 10691 | 5 | 82549227 | 209874191 |
| 10692 | 5 | 82549246 | 82551111 |
| 10693 | 5 | 82549246 | 82552090 |
| 10694 | 5 | 82549246 | 82555641 |
| 10695 | 5 | 82549246 | 82555670 |
| 10696 | 5 | 82549246 | 82556511 |
| 10697 | 5 | 82549246 | 82559047 |
| 10698 | 5 | 82549246 | 82561535 |
| 10699 | 5 | 82549246 | 82610100 |
| 10700 | 5 | 82549246 | 82676822 |
| 10701 | 5 | 82549246 | 82676901 |
| 10702 | 5 | 82549246 | 82883691 |
| 10703 | 5 | 82549246 | 82954942 |
| 10704 | 5 | 82549246 | 82971688 |
| 10705 | 5 | 82549246 | 83023965 |
| 10706 | 5 | 82549246 | 83094205 |

TABLE 1-continued

Examples of chromosomal segments associated with increased fertility in maize.

| Chromosomal Segment | Chr. | Boundary 1 | Boundary 2 |
|---|---|---|---|
| 10707 | 5 | 82549246 | 83146355 |
| 10708 | 5 | 82549246 | 83280630 |
| 10709 | 5 | 82549246 | 83281412 |
| 10710 | 5 | 82549246 | 83400242 |
| 10711 | 5 | 82549246 | 83405797 |
| 10712 | 5 | 82549246 | 83437132 |
| 10713 | 5 | 82549246 | 83522252 |
| 10714 | 5 | 82549246 | 83560095 |
| 10715 | 5 | 82549246 | 83560204 |
| 10716 | 5 | 82549246 | 83572400 |
| 10717 | 5 | 82549246 | 83607661 |
| 10718 | 5 | 82549246 | 83745342 |
| 10719 | 5 | 82549246 | 83861275 |
| 10720 | 5 | 82549246 | 83861633 |
| 10721 | 5 | 82549246 | 83865653 |
| 10722 | 5 | 82549246 | 83865914 |
| 10723 | 5 | 82549246 | 83865920 |
| 10724 | 5 | 82549246 | 83868010 |
| 10725 | 5 | 82549246 | 84019752 |
| 10726 | 5 | 82549246 | 84065912 |
| 10727 | 5 | 82549246 | 84086632 |
| 10728 | 5 | 82549246 | 84089603 |
| 10729 | 5 | 82549246 | 84104814 |
| 10730 | 5 | 82549246 | 84105175 |
| 10731 | 5 | 82549246 | 84251635 |
| 10732 | 5 | 82549246 | 84252180 |
| 10733 | 5 | 82549246 | 84253030 |
| 10734 | 5 | 82549246 | 84254208 |
| 10735 | 5 | 82549246 | 84314930 |
| 10736 | 5 | 82549246 | 84340523 |
| 10737 | 5 | 82549246 | 84516340 |
| 10738 | 5 | 82549246 | 84706916 |
| 10739 | 5 | 82549246 | 84799488 |
| 10740 | 5 | 82549246 | 84801081 |
| 10741 | 5 | 82549246 | 84824103 |
| 10742 | 5 | 82549246 | 84824203 |
| 10743 | 5 | 82549246 | 84824816 |
| 10744 | 5 | 82549246 | 84825422 |
| 10745 | 5 | 82549246 | 84825763 |
| 10746 | 5 | 82549246 | 84825942 |
| 10747 | 5 | 82549246 | 84843411 |
| 10748 | 5 | 82549246 | 84936441 |
| 10749 | 5 | 82549246 | 84936493 |
| 10750 | 5 | 82549246 | 84943705 |
| 10751 | 5 | 82549246 | 169454950 |
| 10752 | 5 | 82549246 | 181522829 |
| 10753 | 5 | 82549246 | 204759879 |
| 10754 | 5 | 82549246 | 209874191 |
| 10755 | 5 | 82549299 | 82551111 |
| 10756 | 5 | 82549299 | 82552090 |
| 10757 | 5 | 82549299 | 82555670 |
| 10758 | 5 | 82549299 | 82556511 |
| 10759 | 5 | 82549299 | 82559047 |
| 10760 | 5 | 82549299 | 82561535 |
| 10761 | 5 | 82549299 | 82610100 |
| 10762 | 5 | 82549299 | 82676822 |
| 10763 | 5 | 82549299 | 82676901 |
| 10764 | 5 | 82549299 | 82883691 |
| 10765 | 5 | 82549299 | 82954942 |
| 10766 | 5 | 82549299 | 82971688 |
| 10767 | 5 | 82549299 | 83023965 |
| 10768 | 5 | 82549299 | 83094205 |
| 10769 | 5 | 82549299 | 83146355 |
| 10770 | 5 | 82549299 | 83280630 |
| 10771 | 5 | 82549299 | 83281412 |
| 10772 | 5 | 82549299 | 83400242 |
| 10773 | 5 | 82549299 | 83405797 |
| 10774 | 5 | 82549299 | 83437132 |
| 10775 | 5 | 82549299 | 83522252 |
| 10776 | 5 | 82549299 | 83560095 |
| 10777 | 5 | 82549299 | 83560204 |
| 10778 | 5 | 82549299 | 83572400 |
| 10779 | 5 | 82549299 | 83607661 |
| 10780 | 5 | 82549299 | 83745342 |
| 10781 | 5 | 82549299 | 83861275 |
| 10782 | 5 | 82549299 | 83861633 |
| 10783 | 5 | 82549299 | 83865653 |
| 10784 | 5 | 82549299 | 83865914 |
| 10785 | 5 | 82549299 | 83865920 |
| 10786 | 5 | 82549299 | 83868010 |
| 10787 | 5 | 82549299 | 84019752 |
| 10788 | 5 | 82549299 | 84065912 |
| 10789 | 5 | 82549299 | 84086632 |
| 10790 | 5 | 82549299 | 84089603 |
| 10791 | 5 | 82549299 | 84104814 |
| 10792 | 5 | 82549299 | 84105175 |
| 10793 | 5 | 82549299 | 84251635 |
| 10794 | 5 | 82549299 | 84252180 |
| 10795 | 5 | 82549299 | 84253030 |
| 10796 | 5 | 82549299 | 84254208 |
| 10797 | 5 | 82549299 | 84314930 |
| 10798 | 5 | 82549299 | 84340523 |
| 10799 | 5 | 82549299 | 84516340 |
| 10800 | 5 | 82549299 | 84706916 |
| 10801 | 5 | 82549299 | 84799488 |
| 10802 | 5 | 82549299 | 84801081 |
| 10803 | 5 | 82549299 | 84824103 |
| 10804 | 5 | 82549299 | 84824203 |
| 10805 | 5 | 82549299 | 84824816 |
| 10806 | 5 | 82549299 | 84825422 |
| 10807 | 5 | 82549299 | 84825763 |
| 10808 | 5 | 82549299 | 84825942 |
| 10809 | 5 | 82549299 | 84843411 |
| 10810 | 5 | 82549299 | 84936441 |
| 10811 | 5 | 82549299 | 84936493 |
| 10812 | 5 | 82549299 | 84943705 |
| 10813 | 5 | 82549299 | 169454950 |
| 10814 | 5 | 82549299 | 181522829 |
| 10815 | 5 | 82549299 | 204759879 |
| 10816 | 5 | 82549299 | 209874191 |
| 10817 | 5 | 82554608 | 82555670 |
| 10818 | 5 | 82554608 | 82556511 |
| 10819 | 5 | 82554608 | 82559047 |
| 10820 | 5 | 82554608 | 82561535 |
| 10821 | 5 | 82554608 | 82610100 |
| 10822 | 5 | 82554608 | 82676822 |
| 10823 | 5 | 82554608 | 82676901 |
| 10824 | 5 | 82554608 | 82883691 |
| 10825 | 5 | 82554608 | 82954942 |
| 10826 | 5 | 82554608 | 82971688 |
| 10827 | 5 | 82554608 | 83023965 |
| 10828 | 5 | 82554608 | 83094205 |
| 10829 | 5 | 82554608 | 83146355 |
| 10830 | 5 | 82554608 | 83280630 |
| 10831 | 5 | 82554608 | 83281412 |
| 10832 | 5 | 82554608 | 83400242 |
| 10833 | 5 | 82554608 | 83405797 |
| 10834 | 5 | 82554608 | 83437132 |
| 10835 | 5 | 82554608 | 83522252 |
| 10836 | 5 | 82554608 | 83560095 |
| 10837 | 5 | 82554608 | 83560204 |
| 10838 | 5 | 82554608 | 83572400 |
| 10839 | 5 | 82554608 | 83607661 |
| 10840 | 5 | 82554608 | 83745342 |
| 10841 | 5 | 82554608 | 83861275 |
| 10842 | 5 | 82554608 | 83861633 |
| 10843 | 5 | 82554608 | 83865653 |
| 10844 | 5 | 82554608 | 83865914 |
| 10845 | 5 | 82554608 | 83865920 |
| 10846 | 5 | 82554608 | 83868010 |
| 10847 | 5 | 82554608 | 84019752 |
| 10848 | 5 | 82554608 | 84065912 |
| 10849 | 5 | 82554608 | 84086632 |
| 10850 | 5 | 82554608 | 84089603 |
| 10851 | 5 | 82554608 | 84104814 |
| 10852 | 5 | 82554608 | 84105175 |
| 10853 | 5 | 82554608 | 84251635 |
| 10854 | 5 | 82554608 | 84252180 |

TABLE 1-continued

Examples of chromosomal segments associated with increased fertility in maize.

| Chromosomal Segment | Chr. | Boundary 1 | Boundary 2 |
|---|---|---|---|
| 10855 | 5 | 82554608 | 84253030 |
| 10856 | 5 | 82554608 | 84254208 |
| 10857 | 5 | 82554608 | 84314930 |
| 10858 | 5 | 82554608 | 84340523 |
| 10859 | 5 | 82554608 | 84516340 |
| 10860 | 5 | 82554608 | 84706916 |
| 10861 | 5 | 82554608 | 84799488 |
| 10862 | 5 | 82554608 | 84801081 |
| 10863 | 5 | 82554608 | 84824103 |
| 10864 | 5 | 82554608 | 84824203 |
| 10865 | 5 | 82554608 | 84824816 |
| 10866 | 5 | 82554608 | 84825422 |
| 10867 | 5 | 82554608 | 84825763 |
| 10868 | 5 | 82554608 | 84825942 |
| 10869 | 5 | 82554608 | 84843411 |
| 10870 | 5 | 82554608 | 84936441 |
| 10871 | 5 | 82554608 | 84936493 |
| 10872 | 5 | 82554608 | 84943705 |
| 10873 | 5 | 82554608 | 169454950 |
| 10874 | 5 | 82554608 | 181522829 |
| 10875 | 5 | 82554608 | 204759879 |
| 10876 | 5 | 82554608 | 209874191 |
| 10877 | 5 | 82555670 | 82556511 |
| 10878 | 5 | 82554971 | 82556511 |
| 10879 | 5 | 82554971 | 82559047 |
| 10880 | 5 | 82554971 | 82561535 |
| 10881 | 5 | 82554971 | 82610100 |
| 10882 | 5 | 82554971 | 82676822 |
| 10883 | 5 | 82554971 | 82676901 |
| 10884 | 5 | 82554971 | 82883691 |
| 10885 | 5 | 82554971 | 82954942 |
| 10886 | 5 | 82554971 | 82971688 |
| 10887 | 5 | 82554971 | 83023965 |
| 10888 | 5 | 82554971 | 83094205 |
| 10889 | 5 | 82554971 | 83146355 |
| 10890 | 5 | 82554971 | 83280630 |
| 10891 | 5 | 82554971 | 83281412 |
| 10892 | 5 | 82554971 | 83400242 |
| 10893 | 5 | 82554971 | 83405797 |
| 10894 | 5 | 82554971 | 83437132 |
| 10895 | 5 | 82554971 | 83522252 |
| 10896 | 5 | 82554971 | 83560095 |
| 10897 | 5 | 82554971 | 83560204 |
| 10898 | 5 | 82554971 | 83572400 |
| 10899 | 5 | 82554971 | 83607661 |
| 10900 | 5 | 82554971 | 83745342 |
| 10901 | 5 | 82554971 | 83861275 |
| 10902 | 5 | 82554971 | 83861633 |
| 10903 | 5 | 82554971 | 83865653 |
| 10904 | 5 | 82554971 | 83865914 |
| 10905 | 5 | 82554971 | 83865920 |
| 10906 | 5 | 82554971 | 83868010 |
| 10907 | 5 | 82554971 | 84019752 |
| 10908 | 5 | 82554971 | 84065912 |
| 10909 | 5 | 82554971 | 84086632 |
| 10910 | 5 | 82554971 | 84089603 |
| 10911 | 5 | 82554971 | 84104814 |
| 10912 | 5 | 82554971 | 84105175 |
| 10913 | 5 | 82554971 | 84251635 |
| 10914 | 5 | 82554971 | 84252180 |
| 10915 | 5 | 82554971 | 84253030 |
| 10916 | 5 | 82554971 | 84254208 |
| 10917 | 5 | 82554971 | 84314930 |
| 10918 | 5 | 82554971 | 84340523 |
| 10919 | 5 | 82554971 | 84516340 |
| 10920 | 5 | 82554971 | 84706916 |
| 10921 | 5 | 82554971 | 84799488 |
| 10922 | 5 | 82554971 | 84801081 |
| 10923 | 5 | 82554971 | 84824103 |
| 10924 | 5 | 82554971 | 84824203 |
| 10925 | 5 | 82554971 | 84824816 |
| 10926 | 5 | 82554971 | 84825422 |
| 10927 | 5 | 82554971 | 84825763 |
| 10928 | 5 | 82554971 | 84825942 |
| 10929 | 5 | 82554971 | 84843411 |
| 10930 | 5 | 82554971 | 84936441 |
| 10931 | 5 | 82554971 | 84936493 |
| 10932 | 5 | 82554971 | 84943705 |
| 10933 | 5 | 82554971 | 169454950 |
| 10934 | 5 | 82554971 | 181522829 |
| 10935 | 5 | 82554971 | 204759879 |
| 10936 | 5 | 82554971 | 209874191 |
| 10937 | 5 | 82556313 | 82556511 |
| 10938 | 5 | 82556313 | 82559047 |
| 10939 | 5 | 82556313 | 82561535 |
| 10940 | 5 | 82556313 | 82610100 |
| 10941 | 5 | 82556313 | 82676822 |
| 10942 | 5 | 82556313 | 82676901 |
| 10943 | 5 | 82556313 | 82883691 |
| 10944 | 5 | 82556313 | 82954942 |
| 10945 | 5 | 82556313 | 82971688 |
| 10946 | 5 | 82556313 | 83023965 |
| 10947 | 5 | 82556313 | 83094205 |
| 10948 | 5 | 82556313 | 83146355 |
| 10949 | 5 | 82556313 | 83280630 |
| 10950 | 5 | 82556313 | 83281412 |
| 10951 | 5 | 82556313 | 83400242 |
| 10952 | 5 | 82556313 | 83405797 |
| 10953 | 5 | 82556313 | 83437132 |
| 10954 | 5 | 82556313 | 83522252 |
| 10955 | 5 | 82556313 | 83560095 |
| 10956 | 5 | 82556313 | 83560204 |
| 10957 | 5 | 82556313 | 83572400 |
| 10958 | 5 | 82556313 | 83607661 |
| 10959 | 5 | 82556313 | 83745342 |
| 10960 | 5 | 82556313 | 83861275 |
| 10961 | 5 | 82556313 | 83861633 |
| 10962 | 5 | 82556313 | 83865653 |
| 10963 | 5 | 82556313 | 83865914 |
| 10964 | 5 | 82556313 | 83865920 |
| 10965 | 5 | 82556313 | 83868010 |
| 10966 | 5 | 82556313 | 84019752 |
| 10967 | 5 | 82556313 | 84065912 |
| 10968 | 5 | 82556313 | 84086632 |
| 10969 | 5 | 82556313 | 84089603 |
| 10970 | 5 | 82556313 | 84104814 |
| 10971 | 5 | 82556313 | 84105175 |
| 10972 | 5 | 82556313 | 84251635 |
| 10973 | 5 | 82556313 | 84252180 |
| 10974 | 5 | 82556313 | 84253030 |
| 10975 | 5 | 82556313 | 84254208 |
| 10976 | 5 | 82556313 | 84314930 |
| 10977 | 5 | 82556313 | 84340523 |
| 10978 | 5 | 82556313 | 84516340 |
| 10979 | 5 | 82556313 | 84706916 |
| 10980 | 5 | 82556313 | 84799488 |
| 10981 | 5 | 82556313 | 84801081 |
| 10982 | 5 | 82556313 | 84824103 |
| 10983 | 5 | 82556313 | 84824203 |
| 10984 | 5 | 82556313 | 84824816 |
| 10985 | 5 | 82556313 | 84825422 |
| 10986 | 5 | 82556313 | 84825763 |
| 10987 | 5 | 82556313 | 84825942 |
| 10988 | 5 | 82556313 | 84843411 |
| 10989 | 5 | 82556313 | 84936441 |
| 10990 | 5 | 82556313 | 84936493 |
| 10991 | 5 | 82556313 | 84943705 |
| 10992 | 5 | 82556313 | 169454950 |
| 10993 | 5 | 82556313 | 181522829 |
| 10994 | 5 | 82556313 | 204759879 |
| 10995 | 5 | 82556313 | 209874191 |
| 10996 | 5 | 82556337 | 82556511 |
| 10997 | 5 | 82556337 | 82559047 |
| 10998 | 5 | 82556337 | 82561535 |
| 10999 | 5 | 82556337 | 82610100 |
| 11000 | 5 | 82556337 | 82676822 |
| 11001 | 5 | 82556337 | 82676901 |
| 11002 | 5 | 82556337 | 82883691 |

TABLE 1-continued

Examples of chromosomal segments associated with increased fertility in maize.

| Chromosomal Segment | Chr. | Boundary 1 | Boundary 2 |
| --- | --- | --- | --- |
| 11003 | 5 | 82556337 | 82954942 |
| 11004 | 5 | 82556337 | 82971688 |
| 11005 | 5 | 82556337 | 83023965 |
| 11006 | 5 | 82556337 | 83094205 |
| 11007 | 5 | 82556337 | 83146355 |
| 11008 | 5 | 82556337 | 83280630 |
| 11009 | 5 | 82556337 | 83281412 |
| 11010 | 5 | 82556337 | 83400242 |
| 11011 | 5 | 82556337 | 83405797 |
| 11012 | 5 | 82556337 | 83437132 |
| 11013 | 5 | 82556337 | 83522252 |
| 11014 | 5 | 82556337 | 83560095 |
| 11015 | 5 | 82556337 | 83560204 |
| 11016 | 5 | 82556337 | 83572400 |
| 11017 | 5 | 82556337 | 83607661 |
| 11018 | 5 | 82556337 | 83745342 |
| 11019 | 5 | 82556337 | 83861275 |
| 11020 | 5 | 82556337 | 83861633 |
| 11021 | 5 | 82556337 | 83865653 |
| 11022 | 5 | 82556337 | 83865914 |
| 11023 | 5 | 82556337 | 83865920 |
| 11024 | 5 | 82556337 | 83868010 |
| 11025 | 5 | 82556337 | 84019752 |
| 11026 | 5 | 82556337 | 84065912 |
| 11027 | 5 | 82556337 | 84086632 |
| 11028 | 5 | 82556337 | 84089603 |
| 11029 | 5 | 82556337 | 84104814 |
| 11030 | 5 | 82556337 | 84105175 |
| 11031 | 5 | 82556337 | 84251635 |
| 11032 | 5 | 82556337 | 84252180 |
| 11033 | 5 | 82556337 | 84253030 |
| 11034 | 5 | 82556337 | 84254208 |
| 11035 | 5 | 82556337 | 84314930 |
| 11036 | 5 | 82556337 | 84340523 |
| 11037 | 5 | 82556337 | 84516340 |
| 11038 | 5 | 82556337 | 84706916 |
| 11039 | 5 | 82556337 | 84799488 |
| 11040 | 5 | 82556337 | 84801081 |
| 11041 | 5 | 82556337 | 84824103 |
| 11042 | 5 | 82556337 | 84824203 |
| 11043 | 5 | 82556337 | 84824816 |
| 11044 | 5 | 82556337 | 84825422 |
| 11045 | 5 | 82556337 | 84825763 |
| 11046 | 5 | 82556337 | 84825942 |
| 11047 | 5 | 82556337 | 84843411 |
| 11048 | 5 | 82556337 | 84936441 |
| 11049 | 5 | 82556337 | 84936493 |
| 11050 | 5 | 82556337 | 84943705 |
| 11051 | 5 | 82556337 | 169454950 |
| 11052 | 5 | 82556337 | 181522829 |
| 11053 | 5 | 82556337 | 204759879 |
| 11054 | 5 | 82556337 | 209874191 |
| 11055 | 5 | 82556511 | 82609175 |
| 11056 | 5 | 82556511 | 82610100 |
| 11057 | 5 | 82556511 | 82676822 |
| 11058 | 5 | 82556511 | 82676901 |
| 11059 | 5 | 82556511 | 82883691 |
| 11060 | 5 | 82556511 | 82954942 |
| 11061 | 5 | 82556511 | 82971688 |
| 11062 | 5 | 82556511 | 83023965 |
| 11063 | 5 | 82556511 | 83094205 |
| 11064 | 5 | 82556511 | 83146355 |
| 11065 | 5 | 82556511 | 83280630 |
| 11066 | 5 | 82556511 | 83281412 |
| 11067 | 5 | 82556511 | 83400242 |
| 11068 | 5 | 82556511 | 83405797 |
| 11069 | 5 | 82556511 | 83437132 |
| 11070 | 5 | 82556511 | 83522252 |
| 11071 | 5 | 82556511 | 83560095 |
| 11072 | 5 | 82556511 | 83560204 |
| 11073 | 5 | 82556511 | 83572400 |
| 11074 | 5 | 82556511 | 83607661 |
| 11075 | 5 | 82556511 | 83745342 |
| 11076 | 5 | 82556511 | 83861275 |
| 11077 | 5 | 82556511 | 83861633 |
| 11078 | 5 | 82556511 | 83865653 |
| 11079 | 5 | 82556511 | 83865914 |
| 11080 | 5 | 82556511 | 83865920 |
| 11081 | 5 | 82556511 | 83868010 |
| 11082 | 5 | 82556511 | 84019752 |
| 11083 | 5 | 82556511 | 84065912 |
| 11084 | 5 | 82556511 | 84086632 |
| 11085 | 5 | 82556511 | 84089603 |
| 11086 | 5 | 82556511 | 84104814 |
| 11087 | 5 | 82556511 | 84105175 |
| 11088 | 5 | 82556511 | 84251635 |
| 11089 | 5 | 82556511 | 84252180 |
| 11090 | 5 | 82556511 | 84253030 |
| 11091 | 5 | 82556511 | 84254208 |
| 11092 | 5 | 82556511 | 84314930 |
| 11093 | 5 | 82556511 | 84340523 |
| 11094 | 5 | 82556511 | 84516340 |
| 11095 | 5 | 82556511 | 84706916 |
| 11096 | 5 | 82556511 | 84799488 |
| 11097 | 5 | 82556511 | 84801081 |
| 11098 | 5 | 82556511 | 84824103 |
| 11099 | 5 | 82556511 | 84824203 |
| 11100 | 5 | 82556511 | 84824816 |
| 11101 | 5 | 82556511 | 84825422 |
| 11102 | 5 | 82556511 | 84825763 |
| 11103 | 5 | 82556511 | 84825942 |
| 11104 | 5 | 82556511 | 84843411 |
| 11105 | 5 | 82556511 | 84936441 |
| 11106 | 5 | 82556511 | 84936493 |
| 11107 | 5 | 82556511 | 84943705 |
| 11108 | 5 | 82556511 | 169454950 |
| 11109 | 5 | 82556511 | 181522829 |
| 11110 | 5 | 82556511 | 204759879 |
| 11111 | 5 | 82556511 | 209874191 |
| 11112 | 5 | 82609175 | 82610100 |
| 11113 | 5 | 82609175 | 82676822 |
| 11114 | 5 | 82609175 | 82676901 |
| 11115 | 5 | 82609175 | 82883691 |
| 11116 | 5 | 82609175 | 82954942 |
| 11117 | 5 | 82609175 | 82971688 |
| 11118 | 5 | 82609175 | 83023965 |
| 11119 | 5 | 82609175 | 83094205 |
| 11120 | 5 | 82609175 | 83146355 |
| 11121 | 5 | 82609175 | 83280630 |
| 11122 | 5 | 82609175 | 83281412 |
| 11123 | 5 | 82609175 | 83400242 |
| 11124 | 5 | 82609175 | 83405797 |
| 11125 | 5 | 82609175 | 83437132 |
| 11126 | 5 | 82609175 | 83522252 |
| 11127 | 5 | 82609175 | 83560095 |
| 11128 | 5 | 82609175 | 83560204 |
| 11129 | 5 | 82609175 | 83572400 |
| 11130 | 5 | 82609175 | 83607661 |
| 11131 | 5 | 82609175 | 83745342 |
| 11132 | 5 | 82609175 | 83861275 |
| 11133 | 5 | 82609175 | 83861633 |
| 11134 | 5 | 82609175 | 83865653 |
| 11135 | 5 | 82609175 | 83865914 |
| 11136 | 5 | 82609175 | 83865920 |
| 11137 | 5 | 82609175 | 83868010 |
| 11138 | 5 | 82609175 | 84019752 |
| 11139 | 5 | 82609175 | 84065912 |
| 11140 | 5 | 82609175 | 84086632 |
| 11141 | 5 | 82609175 | 84089603 |
| 11142 | 5 | 82609175 | 84104814 |
| 11143 | 5 | 82609175 | 84105175 |
| 11144 | 5 | 82609175 | 84251635 |
| 11145 | 5 | 82609175 | 84252180 |
| 11146 | 5 | 82609175 | 84253030 |
| 11147 | 5 | 82609175 | 84254208 |
| 11148 | 5 | 82609175 | 84314930 |
| 11149 | 5 | 82609175 | 84340523 |
| 11150 | 5 | 82609175 | 84516340 |

TABLE 1-continued

Examples of chromosomal segments associated with increased fertility in maize.

| Chromosomal Segment | Chr. | Boundary 1 | Boundary 2 |
|---|---|---|---|
| 11151 | 5 | 82609175 | 84706916 |
| 11152 | 5 | 82609175 | 84799488 |
| 11153 | 5 | 82609175 | 84801081 |
| 11154 | 5 | 82609175 | 84824103 |
| 11155 | 5 | 82609175 | 84824203 |
| 11156 | 5 | 82609175 | 84824816 |
| 11157 | 5 | 82609175 | 84825422 |
| 11158 | 5 | 82609175 | 84825763 |
| 11159 | 5 | 82609175 | 84825942 |
| 11160 | 5 | 82609175 | 84843411 |
| 11161 | 5 | 82609175 | 84936441 |
| 11162 | 5 | 82609175 | 84936493 |
| 11163 | 5 | 82609175 | 84943705 |
| 11164 | 5 | 82609175 | 169454950 |
| 11165 | 5 | 82609175 | 181522829 |
| 11166 | 5 | 82609175 | 204759879 |
| 11167 | 5 | 82609175 | 209874191 |
| 11168 | 5 | 82675654 | 82676822 |
| 11169 | 5 | 82675654 | 82676901 |
| 11170 | 5 | 82675654 | 82883691 |
| 11171 | 5 | 82675654 | 82954942 |
| 11172 | 5 | 82675654 | 82971688 |
| 11173 | 5 | 82675654 | 83023965 |
| 11174 | 5 | 82675654 | 83094205 |
| 11175 | 5 | 82675654 | 83146355 |
| 11176 | 5 | 82675654 | 83280630 |
| 11177 | 5 | 82675654 | 83281412 |
| 11178 | 5 | 82675654 | 83400242 |
| 11179 | 5 | 82675654 | 83405797 |
| 11180 | 5 | 82675654 | 83437132 |
| 11181 | 5 | 82675654 | 83522252 |
| 11182 | 5 | 82675654 | 83560095 |
| 11183 | 5 | 82675654 | 83560204 |
| 11184 | 5 | 82675654 | 83572400 |
| 11185 | 5 | 82675654 | 83607661 |
| 11186 | 5 | 82675654 | 83745342 |
| 11187 | 5 | 82675654 | 83861275 |
| 11188 | 5 | 82675654 | 83861633 |
| 11189 | 5 | 82675654 | 83865653 |
| 11190 | 5 | 82675654 | 83865914 |
| 11191 | 5 | 82675654 | 83865920 |
| 11192 | 5 | 82675654 | 83868010 |
| 11193 | 5 | 82675654 | 84019752 |
| 11194 | 5 | 82675654 | 84065912 |
| 11195 | 5 | 82675654 | 84086632 |
| 11196 | 5 | 82675654 | 84089603 |
| 11197 | 5 | 82675654 | 84104814 |
| 11198 | 5 | 82675654 | 84105175 |
| 11199 | 5 | 82675654 | 84251635 |
| 11200 | 5 | 82675654 | 84252180 |
| 11201 | 5 | 82675654 | 84253030 |
| 11202 | 5 | 82675654 | 84254208 |
| 11203 | 5 | 82675654 | 84314930 |
| 11204 | 5 | 82675654 | 84340523 |
| 11205 | 5 | 82675654 | 84516340 |
| 11206 | 5 | 82675654 | 84706916 |
| 11207 | 5 | 82675654 | 84799488 |
| 11208 | 5 | 82675654 | 84801081 |
| 11209 | 5 | 82675654 | 84824103 |
| 11210 | 5 | 82675654 | 84824203 |
| 11211 | 5 | 82675654 | 84824816 |
| 11212 | 5 | 82675654 | 84825422 |
| 11213 | 5 | 82675654 | 84825763 |
| 11214 | 5 | 82675654 | 84825942 |
| 11215 | 5 | 82675654 | 84843411 |
| 11216 | 5 | 82675654 | 84936441 |
| 11217 | 5 | 82675654 | 84936493 |
| 11218 | 5 | 82675654 | 84943705 |
| 11219 | 5 | 82675654 | 169454950 |
| 11220 | 5 | 82675654 | 181522829 |
| 11221 | 5 | 82675654 | 204759879 |
| 11222 | 5 | 82675654 | 209874191 |
| 11223 | 5 | 82675825 | 82676822 |
| 11224 | 5 | 82675825 | 82676901 |
| 11225 | 5 | 82675825 | 82883691 |
| 11226 | 5 | 82675825 | 82954942 |
| 11227 | 5 | 82675825 | 82971688 |
| 11228 | 5 | 82675825 | 83023965 |
| 11229 | 5 | 82675825 | 83094205 |
| 11230 | 5 | 82675825 | 83146355 |
| 11231 | 5 | 82675825 | 83280630 |
| 11232 | 5 | 82675825 | 83281412 |
| 11233 | 5 | 82675825 | 83400242 |
| 11234 | 5 | 82675825 | 83405797 |
| 11235 | 5 | 82675825 | 83437132 |
| 11236 | 5 | 82675825 | 83522252 |
| 11237 | 5 | 82675825 | 83560095 |
| 11238 | 5 | 82675825 | 83560204 |
| 11239 | 5 | 82675825 | 83572400 |
| 11240 | 5 | 82675825 | 83607661 |
| 11241 | 5 | 82675825 | 83745342 |
| 11242 | 5 | 82675825 | 83861275 |
| 11243 | 5 | 82675825 | 83861633 |
| 11244 | 5 | 82675825 | 83865653 |
| 11245 | 5 | 82675825 | 83865914 |
| 11246 | 5 | 82675825 | 83865920 |
| 11247 | 5 | 82675825 | 83868010 |
| 11248 | 5 | 82675825 | 84019752 |
| 11249 | 5 | 82675825 | 84065912 |
| 11250 | 5 | 82675825 | 84086632 |
| 11251 | 5 | 82675825 | 84089603 |
| 11252 | 5 | 82675825 | 84104814 |
| 11253 | 5 | 82675825 | 84105175 |
| 11254 | 5 | 82675825 | 84251635 |
| 11255 | 5 | 82675825 | 84252180 |
| 11256 | 5 | 82675825 | 84253030 |
| 11257 | 5 | 82675825 | 84254208 |
| 11258 | 5 | 82675825 | 84314930 |
| 11259 | 5 | 82675825 | 84340523 |
| 11260 | 5 | 82675825 | 84516340 |
| 11261 | 5 | 82675825 | 84706916 |
| 11262 | 5 | 82675825 | 84799488 |
| 11263 | 5 | 82675825 | 84801081 |
| 11264 | 5 | 82675825 | 84824103 |
| 11265 | 5 | 82675825 | 84824203 |
| 11266 | 5 | 82675825 | 84824816 |
| 11267 | 5 | 82675825 | 84825422 |
| 11268 | 5 | 82675825 | 84825763 |
| 11269 | 5 | 82675825 | 84825942 |
| 11270 | 5 | 82675825 | 84843411 |
| 11271 | 5 | 82675825 | 84936441 |
| 11272 | 5 | 82675825 | 84936493 |
| 11273 | 5 | 82675825 | 84943705 |
| 11274 | 5 | 82675825 | 169454950 |
| 11275 | 5 | 82675825 | 181522829 |
| 11276 | 5 | 82675825 | 204759879 |
| 11277 | 5 | 82675825 | 209874191 |
| 11278 | 5 | 82882273 | 82883691 |
| 11279 | 5 | 82882273 | 82954942 |
| 11280 | 5 | 82882273 | 82971688 |
| 11281 | 5 | 82882273 | 83023965 |
| 11282 | 5 | 82882273 | 83094205 |
| 11283 | 5 | 82882273 | 83146355 |
| 11284 | 5 | 82882273 | 83280630 |
| 11285 | 5 | 82882273 | 83281412 |
| 11286 | 5 | 82882273 | 83400242 |
| 11287 | 5 | 82882273 | 83405797 |
| 11288 | 5 | 82882273 | 83437132 |
| 11289 | 5 | 82882273 | 83522252 |
| 11290 | 5 | 82882273 | 83560095 |
| 11291 | 5 | 82882273 | 83560204 |
| 11292 | 5 | 82882273 | 83572400 |
| 11293 | 5 | 82882273 | 83607661 |
| 11294 | 5 | 82882273 | 83745342 |
| 11295 | 5 | 82882273 | 83861275 |
| 11296 | 5 | 82882273 | 83861633 |
| 11297 | 5 | 82882273 | 83865653 |
| 11298 | 5 | 82882273 | 83865914 |

TABLE 1-continued

Examples of chromosomal segments associated with increased fertility in maize.

| Chromosomal Segment | Chr. | Boundary 1 | Boundary 2 |
|---|---|---|---|
| 11299 | 5 | 82882273 | 83865920 |
| 11300 | 5 | 82882273 | 83868010 |
| 11301 | 5 | 82882273 | 84019752 |
| 11302 | 5 | 82882273 | 84065912 |
| 11303 | 5 | 82882273 | 84086632 |
| 11304 | 5 | 82882273 | 84089603 |
| 11305 | 5 | 82882273 | 84104814 |
| 11306 | 5 | 82882273 | 84105175 |
| 11307 | 5 | 82882273 | 84251635 |
| 11308 | 5 | 82882273 | 84252180 |
| 11309 | 5 | 82882273 | 84253030 |
| 11310 | 5 | 82882273 | 84254208 |
| 11311 | 5 | 82882273 | 84314930 |
| 11312 | 5 | 82882273 | 84340523 |
| 11313 | 5 | 82882273 | 84516340 |
| 11314 | 5 | 82882273 | 84706916 |
| 11315 | 5 | 82882273 | 84799488 |
| 11316 | 5 | 82882273 | 84801081 |
| 11317 | 5 | 82882273 | 84824103 |
| 11318 | 5 | 82882273 | 84824203 |
| 11319 | 5 | 82882273 | 84824816 |
| 11320 | 5 | 82882273 | 84825422 |
| 11321 | 5 | 82882273 | 84825763 |
| 11322 | 5 | 82882273 | 84825942 |
| 11323 | 5 | 82882273 | 84843411 |
| 11324 | 5 | 82882273 | 84936441 |
| 11325 | 5 | 82882273 | 84936493 |
| 11326 | 5 | 82882273 | 84943705 |
| 11327 | 5 | 82882273 | 169454950 |
| 11328 | 5 | 82882273 | 181522829 |
| 11329 | 5 | 82882273 | 204759879 |
| 11330 | 5 | 82882273 | 209874191 |
| 11331 | 5 | 82953053 | 82954942 |
| 11332 | 5 | 82953053 | 82971688 |
| 11333 | 5 | 82953053 | 83023965 |
| 11334 | 5 | 82953053 | 83094205 |
| 11335 | 5 | 82953053 | 83146355 |
| 11336 | 5 | 82953053 | 83280630 |
| 11337 | 5 | 82953053 | 83281412 |
| 11338 | 5 | 82953053 | 83400242 |
| 11339 | 5 | 82953053 | 83405797 |
| 11340 | 5 | 82953053 | 83437132 |
| 11341 | 5 | 82953053 | 83522252 |
| 11342 | 5 | 82953053 | 83560095 |
| 11343 | 5 | 82953053 | 83560204 |
| 11344 | 5 | 82953053 | 83572400 |
| 11345 | 5 | 82953053 | 83607661 |
| 11346 | 5 | 82953053 | 83745342 |
| 11347 | 5 | 82953053 | 83861275 |
| 11348 | 5 | 82953053 | 83861633 |
| 11349 | 5 | 82953053 | 83865653 |
| 11350 | 5 | 82953053 | 83865914 |
| 11351 | 5 | 82953053 | 83865920 |
| 11352 | 5 | 82953053 | 83868010 |
| 11353 | 5 | 82953053 | 84019752 |
| 11354 | 5 | 82953053 | 84065912 |
| 11355 | 5 | 82953053 | 84086632 |
| 11356 | 5 | 82953053 | 84089603 |
| 11357 | 5 | 82953053 | 84104814 |
| 11358 | 5 | 82953053 | 84105175 |
| 11359 | 5 | 82953053 | 84251635 |
| 11360 | 5 | 82953053 | 84252180 |
| 11361 | 5 | 82953053 | 84253030 |
| 11362 | 5 | 82953053 | 84254208 |
| 11363 | 5 | 82953053 | 84314930 |
| 11364 | 5 | 82953053 | 84340523 |
| 11365 | 5 | 82953053 | 84516340 |
| 11366 | 5 | 82953053 | 84706916 |
| 11367 | 5 | 82953053 | 84799488 |
| 11368 | 5 | 82953053 | 84801081 |
| 11369 | 5 | 82953053 | 84824103 |
| 11370 | 5 | 82953053 | 84824203 |
| 11371 | 5 | 82953053 | 84824816 |
| 11372 | 5 | 82953053 | 84825422 |
| 11373 | 5 | 82953053 | 84825763 |
| 11374 | 5 | 82953053 | 84825942 |
| 11375 | 5 | 82953053 | 84843411 |
| 11376 | 5 | 82953053 | 84936441 |
| 11377 | 5 | 82953053 | 84936493 |
| 11378 | 5 | 82953053 | 84943705 |
| 11379 | 5 | 82953053 | 169454950 |
| 11380 | 5 | 82953053 | 181522829 |
| 11381 | 5 | 82953053 | 204759879 |
| 11382 | 5 | 82953053 | 209874191 |
| 11383 | 5 | 82971168 | 82971688 |
| 11384 | 5 | 82971168 | 83023965 |
| 11385 | 5 | 82971168 | 83094205 |
| 11386 | 5 | 82971168 | 83146355 |
| 11387 | 5 | 82971168 | 83280630 |
| 11388 | 5 | 82971168 | 83281412 |
| 11389 | 5 | 82971168 | 83400242 |
| 11390 | 5 | 82971168 | 83405797 |
| 11391 | 5 | 82971168 | 83437132 |
| 11392 | 5 | 82971168 | 83522252 |
| 11393 | 5 | 82971168 | 83560095 |
| 11394 | 5 | 82971168 | 83560204 |
| 11395 | 5 | 82971168 | 83572400 |
| 11396 | 5 | 82971168 | 83607661 |
| 11397 | 5 | 82971168 | 83745342 |
| 11398 | 5 | 82971168 | 83861275 |
| 11399 | 5 | 82971168 | 83861633 |
| 11400 | 5 | 82971168 | 83865653 |
| 11401 | 5 | 82971168 | 83865914 |
| 11402 | 5 | 82971168 | 83865920 |
| 11403 | 5 | 82971168 | 83868010 |
| 11404 | 5 | 82971168 | 84019752 |
| 11405 | 5 | 82971168 | 84065912 |
| 11406 | 5 | 82971168 | 84086632 |
| 11407 | 5 | 82971168 | 84089603 |
| 11408 | 5 | 82971168 | 84104814 |
| 11409 | 5 | 82971168 | 84105175 |
| 11410 | 5 | 82971168 | 84251635 |
| 11411 | 5 | 82971168 | 84252180 |
| 11412 | 5 | 82971168 | 84253030 |
| 11413 | 5 | 82971168 | 84254208 |
| 11414 | 5 | 82971168 | 84314930 |
| 11415 | 5 | 82971168 | 84340523 |
| 11416 | 5 | 82971168 | 84516340 |
| 11417 | 5 | 82971168 | 84706916 |
| 11418 | 5 | 82971168 | 84799488 |
| 11419 | 5 | 82971168 | 84801081 |
| 11420 | 5 | 82971168 | 84824103 |
| 11421 | 5 | 82971168 | 84824203 |
| 11422 | 5 | 82971168 | 84824816 |
| 11423 | 5 | 82971168 | 84825422 |
| 11424 | 5 | 82971168 | 84825763 |
| 11425 | 5 | 82971168 | 84825942 |
| 11426 | 5 | 82971168 | 84843411 |
| 11427 | 5 | 82971168 | 84936441 |
| 11428 | 5 | 82971168 | 84936493 |
| 11429 | 5 | 82971168 | 84943705 |
| 11430 | 5 | 82971168 | 169454950 |
| 11431 | 5 | 82971168 | 181522829 |
| 11432 | 5 | 82971168 | 204759879 |
| 11433 | 5 | 82971168 | 209874191 |
| 11434 | 5 | 83023500 | 83023965 |
| 11435 | 5 | 83023500 | 83094205 |
| 11436 | 5 | 83023500 | 83146355 |
| 11437 | 5 | 83023500 | 83280630 |
| 11438 | 5 | 83023500 | 83281412 |
| 11439 | 5 | 83023500 | 83400242 |
| 11440 | 5 | 83023500 | 83405797 |
| 11441 | 5 | 83023500 | 83437132 |
| 11442 | 5 | 83023500 | 83522252 |
| 11443 | 5 | 83023500 | 83560095 |
| 11444 | 5 | 83023500 | 83560204 |
| 11445 | 5 | 83023500 | 83572400 |
| 11446 | 5 | 83023500 | 83607661 |

TABLE 1-continued

Examples of chromosomal segments associated with increased fertility in maize.

| Chromosomal Segment | Chr. | Boundary 1 | Boundary 2 |
|---|---|---|---|
| 11447 | 5 | 83023500 | 83745342 |
| 11448 | 5 | 83023500 | 83861275 |
| 11449 | 5 | 83023500 | 83861633 |
| 11450 | 5 | 83023500 | 83865653 |
| 11451 | 5 | 83023500 | 83865914 |
| 11452 | 5 | 83023500 | 83865920 |
| 11453 | 5 | 83023500 | 83868010 |
| 11454 | 5 | 83023500 | 84019752 |
| 11455 | 5 | 83023500 | 84065912 |
| 11456 | 5 | 83023500 | 84086632 |
| 11457 | 5 | 83023500 | 84089603 |
| 11458 | 5 | 83023500 | 84104814 |
| 11459 | 5 | 83023500 | 84105175 |
| 11460 | 5 | 83023500 | 84251635 |
| 11461 | 5 | 83023500 | 84252180 |
| 11462 | 5 | 83023500 | 84253030 |
| 11463 | 5 | 83023500 | 84254208 |
| 11464 | 5 | 83023500 | 84314930 |
| 11465 | 5 | 83023500 | 84340523 |
| 11466 | 5 | 83023500 | 84516340 |
| 11467 | 5 | 83023500 | 84706916 |
| 11468 | 5 | 83023500 | 84799488 |
| 11469 | 5 | 83023500 | 84801081 |
| 11470 | 5 | 83023500 | 84824103 |
| 11471 | 5 | 83023500 | 84824203 |
| 11472 | 5 | 83023500 | 84824816 |
| 11473 | 5 | 83023500 | 84825422 |
| 11474 | 5 | 83023500 | 84825763 |
| 11475 | 5 | 83023500 | 84825942 |
| 11476 | 5 | 83023500 | 84843411 |
| 11477 | 5 | 83023500 | 84936441 |
| 11478 | 5 | 83023500 | 84936493 |
| 11479 | 5 | 83023500 | 84943705 |
| 11480 | 5 | 83023500 | 169454950 |
| 11481 | 5 | 83023500 | 181522829 |
| 11482 | 5 | 83023500 | 204759879 |
| 11483 | 5 | 83023500 | 209874191 |
| 11484 | 5 | 83093332 | 83094205 |
| 11485 | 5 | 83093332 | 83146355 |
| 11486 | 5 | 83093332 | 83280630 |
| 11487 | 5 | 83093332 | 83281412 |
| 11488 | 5 | 83093332 | 83400242 |
| 11489 | 5 | 83093332 | 83405797 |
| 11490 | 5 | 83093332 | 83437132 |
| 11491 | 5 | 83093332 | 83522252 |
| 11492 | 5 | 83093332 | 83560095 |
| 11493 | 5 | 83093332 | 83560204 |
| 11494 | 5 | 83093332 | 83572400 |
| 11495 | 5 | 83093332 | 83607661 |
| 11496 | 5 | 83093332 | 83745342 |
| 11497 | 5 | 83093332 | 83861275 |
| 11498 | 5 | 83093332 | 83861633 |
| 11499 | 5 | 83093332 | 83865653 |
| 11500 | 5 | 83093332 | 83865914 |
| 11501 | 5 | 83093332 | 83865920 |
| 11502 | 5 | 83093332 | 83868010 |
| 11503 | 5 | 83093332 | 84019752 |
| 11504 | 5 | 83093332 | 84065912 |
| 11505 | 5 | 83093332 | 84086632 |
| 11506 | 5 | 83093332 | 84089603 |
| 11507 | 5 | 83093332 | 84104814 |
| 11508 | 5 | 83093332 | 84105175 |
| 11509 | 5 | 83093332 | 84251635 |
| 11510 | 5 | 83093332 | 84252180 |
| 11511 | 5 | 83093332 | 84253030 |
| 11512 | 5 | 83093332 | 84254208 |
| 11513 | 5 | 83093332 | 84314930 |
| 11514 | 5 | 83093332 | 84340523 |
| 11515 | 5 | 83093332 | 84516340 |
| 11516 | 5 | 83093332 | 84706916 |
| 11517 | 5 | 83093332 | 84799488 |
| 11518 | 5 | 83093332 | 84801081 |
| 11519 | 5 | 83093332 | 84824103 |
| 11520 | 5 | 83093332 | 84824203 |
| 11521 | 5 | 83093332 | 84824816 |
| 11522 | 5 | 83093332 | 84825422 |
| 11523 | 5 | 83093332 | 84825763 |
| 11524 | 5 | 83093332 | 84825942 |
| 11525 | 5 | 83093332 | 84843411 |
| 11526 | 5 | 83093332 | 84936441 |
| 11527 | 5 | 83093332 | 84936493 |
| 11528 | 5 | 83093332 | 84943705 |
| 11529 | 5 | 83093332 | 169454950 |
| 11530 | 5 | 83093332 | 181522829 |
| 11531 | 5 | 83093332 | 204759879 |
| 11532 | 5 | 83093332 | 209874191 |
| 11533 | 5 | 83145879 | 83146355 |
| 11534 | 5 | 83145879 | 83280630 |
| 11535 | 5 | 83145879 | 83281412 |
| 11536 | 5 | 83145879 | 83400242 |
| 11537 | 5 | 83145879 | 83405797 |
| 11538 | 5 | 83145879 | 83437132 |
| 11539 | 5 | 83145879 | 83522252 |
| 11540 | 5 | 83145879 | 83560095 |
| 11541 | 5 | 83145879 | 83560204 |
| 11542 | 5 | 83145879 | 83572400 |
| 11543 | 5 | 83145879 | 83607661 |
| 11544 | 5 | 83145879 | 83745342 |
| 11545 | 5 | 83145879 | 83861275 |
| 11546 | 5 | 83145879 | 83861633 |
| 11547 | 5 | 83145879 | 83865653 |
| 11548 | 5 | 83145879 | 83865914 |
| 11549 | 5 | 83145879 | 83865920 |
| 11550 | 5 | 83145879 | 83868010 |
| 11551 | 5 | 83145879 | 84019752 |
| 11552 | 5 | 83145879 | 84065912 |
| 11553 | 5 | 83145879 | 84086632 |
| 11554 | 5 | 83145879 | 84089603 |
| 11555 | 5 | 83145879 | 84104814 |
| 11556 | 5 | 83145879 | 84105175 |
| 11557 | 5 | 83145879 | 84251635 |
| 11558 | 5 | 83145879 | 84252180 |
| 11559 | 5 | 83145879 | 84253030 |
| 11560 | 5 | 83145879 | 84254208 |
| 11561 | 5 | 83145879 | 84314930 |
| 11562 | 5 | 83145879 | 84340523 |
| 11563 | 5 | 83145879 | 84516340 |
| 11564 | 5 | 83145879 | 84706916 |
| 11565 | 5 | 83145879 | 84799488 |
| 11566 | 5 | 83145879 | 84801081 |
| 11567 | 5 | 83145879 | 84824103 |
| 11568 | 5 | 83145879 | 84824203 |
| 11569 | 5 | 83145879 | 84824816 |
| 11570 | 5 | 83145879 | 84825422 |
| 11571 | 5 | 83145879 | 84825763 |
| 11572 | 5 | 83145879 | 84825942 |
| 11573 | 5 | 83145879 | 84843411 |
| 11574 | 5 | 83145879 | 84936441 |
| 11575 | 5 | 83145879 | 84936493 |
| 11576 | 5 | 83145879 | 84943705 |
| 11577 | 5 | 83145879 | 169454950 |
| 11578 | 5 | 83145879 | 181522829 |
| 11579 | 5 | 83145879 | 204759879 |
| 11580 | 5 | 83145879 | 209874191 |
| 11581 | 5 | 83277783 | 83280630 |
| 11582 | 5 | 83277783 | 83281412 |
| 11583 | 5 | 83277783 | 83400242 |
| 11584 | 5 | 83277783 | 83405797 |
| 11585 | 5 | 83277783 | 83437132 |
| 11586 | 5 | 83277783 | 83522252 |
| 11587 | 5 | 83277783 | 83560095 |
| 11588 | 5 | 83277783 | 83560204 |
| 11589 | 5 | 83277783 | 83572400 |
| 11590 | 5 | 83277783 | 83607661 |
| 11591 | 5 | 83277783 | 83745342 |
| 11592 | 5 | 83277783 | 83861275 |
| 11593 | 5 | 83277783 | 83861633 |
| 11594 | 5 | 83277783 | 83865653 |

TABLE 1-continued

Examples of chromosomal segments associated with increased fertility in maize.

| Chromosomal Segment | Chr. | Boundary 1 | Boundary 2 |
|---|---|---|---|
| 11595 | 5 | 83277783 | 83865914 |
| 11596 | 5 | 83277783 | 83865920 |
| 11597 | 5 | 83277783 | 83868010 |
| 11598 | 5 | 83277783 | 84019752 |
| 11599 | 5 | 83277783 | 84065912 |
| 11600 | 5 | 83277783 | 84086632 |
| 11601 | 5 | 83277783 | 84089603 |
| 11602 | 5 | 83277783 | 84104814 |
| 11603 | 5 | 83277783 | 84105175 |
| 11604 | 5 | 83277783 | 84251635 |
| 11605 | 5 | 83277783 | 84252180 |
| 11606 | 5 | 83277783 | 84253030 |
| 11607 | 5 | 83277783 | 84254208 |
| 11608 | 5 | 83277783 | 84314930 |
| 11609 | 5 | 83277783 | 84340523 |
| 11610 | 5 | 83277783 | 84516340 |
| 11611 | 5 | 83277783 | 84706916 |
| 11612 | 5 | 83277783 | 84799488 |
| 11613 | 5 | 83277783 | 84801081 |
| 11614 | 5 | 83277783 | 84824103 |
| 11615 | 5 | 83277783 | 84824203 |
| 11616 | 5 | 83277783 | 84824816 |
| 11617 | 5 | 83277783 | 84825422 |
| 11618 | 5 | 83277783 | 84825763 |
| 11619 | 5 | 83277783 | 84825942 |
| 11620 | 5 | 83277783 | 84843411 |
| 11621 | 5 | 83277783 | 84936441 |
| 11622 | 5 | 83277783 | 84936493 |
| 11623 | 5 | 83277783 | 84943705 |
| 11624 | 5 | 83277783 | 169454950 |
| 11625 | 5 | 83277783 | 181522829 |
| 11626 | 5 | 83277783 | 204759879 |
| 11627 | 5 | 83277783 | 209874191 |
| 11628 | 5 | 83277785 | 83280630 |
| 11629 | 5 | 83277785 | 83281412 |
| 11630 | 5 | 83277785 | 83400242 |
| 11631 | 5 | 83277785 | 83405797 |
| 11632 | 5 | 83277785 | 83437132 |
| 11633 | 5 | 83277785 | 83522252 |
| 11634 | 5 | 83277785 | 83560095 |
| 11635 | 5 | 83277785 | 83560204 |
| 11636 | 5 | 83277785 | 83572400 |
| 11637 | 5 | 83277785 | 83607661 |
| 11638 | 5 | 83277785 | 83745342 |
| 11639 | 5 | 83277785 | 83861275 |
| 11640 | 5 | 83277785 | 83861633 |
| 11641 | 5 | 83277785 | 83865653 |
| 11642 | 5 | 83277785 | 83865914 |
| 11643 | 5 | 83277785 | 83865920 |
| 11644 | 5 | 83277785 | 83868010 |
| 11645 | 5 | 83277785 | 84019752 |
| 11646 | 5 | 83277785 | 84065912 |
| 11647 | 5 | 83277785 | 84086632 |
| 11648 | 5 | 83277785 | 84089603 |
| 11649 | 5 | 83277785 | 84104814 |
| 11650 | 5 | 83277785 | 84105175 |
| 11651 | 5 | 83277785 | 84251635 |
| 11652 | 5 | 83277785 | 84252180 |
| 11653 | 5 | 83277785 | 84253030 |
| 11654 | 5 | 83277785 | 84254208 |
| 11655 | 5 | 83277785 | 84314930 |
| 11656 | 5 | 83277785 | 84340523 |
| 11657 | 5 | 83277785 | 84516340 |
| 11658 | 5 | 83277785 | 84706916 |
| 11659 | 5 | 83277785 | 84799488 |
| 11660 | 5 | 83277785 | 84801081 |
| 11661 | 5 | 83277785 | 84824103 |
| 11662 | 5 | 83277785 | 84824203 |
| 11663 | 5 | 83277785 | 84824816 |
| 11664 | 5 | 83277785 | 84825422 |
| 11665 | 5 | 83277785 | 84825763 |
| 11666 | 5 | 83277785 | 84825942 |
| 11667 | 5 | 83277785 | 84843411 |
| 11668 | 5 | 83277785 | 84936441 |
| 11669 | 5 | 83277785 | 84936493 |
| 11670 | 5 | 83277785 | 84943705 |
| 11671 | 5 | 83277785 | 169454950 |
| 11672 | 5 | 83277785 | 181522829 |
| 11673 | 5 | 83277785 | 204759879 |
| 11674 | 5 | 83277785 | 209874191 |
| 11675 | 5 | 83279034 | 83280630 |
| 11676 | 5 | 83279034 | 83281412 |
| 11677 | 5 | 83279034 | 83400242 |
| 11678 | 5 | 83279034 | 83405797 |
| 11679 | 5 | 83279034 | 83437132 |
| 11680 | 5 | 83279034 | 83522252 |
| 11681 | 5 | 83279034 | 83560095 |
| 11682 | 5 | 83279034 | 83560204 |
| 11683 | 5 | 83279034 | 83572400 |
| 11684 | 5 | 83279034 | 83607661 |
| 11685 | 5 | 83279034 | 83745342 |
| 11686 | 5 | 83279034 | 83861275 |
| 11687 | 5 | 83279034 | 83861633 |
| 11688 | 5 | 83279034 | 83865653 |
| 11689 | 5 | 83279034 | 83865914 |
| 11690 | 5 | 83279034 | 83865920 |
| 11691 | 5 | 83279034 | 83868010 |
| 11692 | 5 | 83279034 | 84019752 |
| 11693 | 5 | 83279034 | 84065912 |
| 11694 | 5 | 83279034 | 84086632 |
| 11695 | 5 | 83279034 | 84089603 |
| 11696 | 5 | 83279034 | 84104814 |
| 11697 | 5 | 83279034 | 84105175 |
| 11698 | 5 | 83279034 | 84251635 |
| 11699 | 5 | 83279034 | 84252180 |
| 11700 | 5 | 83279034 | 84253030 |
| 11701 | 5 | 83279034 | 84254208 |
| 11702 | 5 | 83279034 | 84314930 |
| 11703 | 5 | 83279034 | 84340523 |
| 11704 | 5 | 83279034 | 84516340 |
| 11705 | 5 | 83279034 | 84706916 |
| 11706 | 5 | 83279034 | 84799488 |
| 11707 | 5 | 83279034 | 84801081 |
| 11708 | 5 | 83279034 | 84824103 |
| 11709 | 5 | 83279034 | 84824203 |
| 11710 | 5 | 83279034 | 84824816 |
| 11711 | 5 | 83279034 | 84825422 |
| 11712 | 5 | 83279034 | 84825763 |
| 11713 | 5 | 83279034 | 84825942 |
| 11714 | 5 | 83279034 | 84843411 |
| 11715 | 5 | 83279034 | 84936441 |
| 11716 | 5 | 83279034 | 84936493 |
| 11717 | 5 | 83279034 | 84943705 |
| 11718 | 5 | 83279034 | 169454950 |
| 11719 | 5 | 83279034 | 181522829 |
| 11720 | 5 | 83279034 | 204759879 |
| 11721 | 5 | 83279034 | 209874191 |
| 11722 | 5 | 83397014 | 83400242 |
| 11723 | 5 | 83397014 | 83405797 |
| 11724 | 5 | 83397014 | 83437132 |
| 11725 | 5 | 83397014 | 83522252 |
| 11726 | 5 | 83397014 | 83560095 |
| 11727 | 5 | 83397014 | 83560204 |
| 11728 | 5 | 83397014 | 83572400 |
| 11729 | 5 | 83397014 | 83607661 |
| 11730 | 5 | 83397014 | 83745342 |
| 11731 | 5 | 83397014 | 83861275 |
| 11732 | 5 | 83397014 | 83861633 |
| 11733 | 5 | 83397014 | 83865653 |
| 11734 | 5 | 83397014 | 83865914 |
| 11735 | 5 | 83397014 | 83865920 |
| 11736 | 5 | 83397014 | 83868010 |
| 11737 | 5 | 83397014 | 84019752 |
| 11738 | 5 | 83397014 | 84065912 |
| 11739 | 5 | 83397014 | 84086632 |
| 11740 | 5 | 83397014 | 84089603 |
| 11741 | 5 | 83397014 | 84104814 |
| 11742 | 5 | 83397014 | 84105175 |

TABLE 1-continued

Examples of chromosomal segments associated with increased fertility in maize.

| Chromosomal Segment | Chr. | Boundary 1 | Boundary 2 |
|---|---|---|---|
| 11743 | 5 | 83397014 | 84251635 |
| 11744 | 5 | 83397014 | 84252180 |
| 11745 | 5 | 83397014 | 84253030 |
| 11746 | 5 | 83397014 | 84254208 |
| 11747 | 5 | 83397014 | 84314930 |
| 11748 | 5 | 83397014 | 84340523 |
| 11749 | 5 | 83397014 | 84516340 |
| 11750 | 5 | 83397014 | 84706916 |
| 11751 | 5 | 83397014 | 84799488 |
| 11752 | 5 | 83397014 | 84801081 |
| 11753 | 5 | 83397014 | 84824103 |
| 11754 | 5 | 83397014 | 84824203 |
| 11755 | 5 | 83397014 | 84824816 |
| 11756 | 5 | 83397014 | 84825422 |
| 11757 | 5 | 83397014 | 84825763 |
| 11758 | 5 | 83397014 | 84825942 |
| 11759 | 5 | 83397014 | 84843411 |
| 11760 | 5 | 83397014 | 84936441 |
| 11761 | 5 | 83397014 | 84936493 |
| 11762 | 5 | 83397014 | 84943705 |
| 11763 | 5 | 83397014 | 169454950 |
| 11764 | 5 | 83397014 | 181522829 |
| 11765 | 5 | 83397014 | 204759879 |
| 11766 | 5 | 83397014 | 209874191 |
| 11767 | 5 | 83402967 | 83405797 |
| 11768 | 5 | 83402967 | 83437132 |
| 11769 | 5 | 83402967 | 83522252 |
| 11770 | 5 | 83402967 | 83560095 |
| 11771 | 5 | 83402967 | 83560204 |
| 11772 | 5 | 83402967 | 83572400 |
| 11773 | 5 | 83402967 | 83607661 |
| 11774 | 5 | 83402967 | 83745342 |
| 11775 | 5 | 83402967 | 83861275 |
| 11776 | 5 | 83402967 | 83861633 |
| 11777 | 5 | 83402967 | 83865653 |
| 11778 | 5 | 83402967 | 83865914 |
| 11779 | 5 | 83402967 | 83865920 |
| 11780 | 5 | 83402967 | 83868010 |
| 11781 | 5 | 83402967 | 84019752 |
| 11782 | 5 | 83402967 | 84065912 |
| 11783 | 5 | 83402967 | 84086632 |
| 11784 | 5 | 83402967 | 84089603 |
| 11785 | 5 | 83402967 | 84104814 |
| 11786 | 5 | 83402967 | 84105175 |
| 11787 | 5 | 83402967 | 84251635 |
| 11788 | 5 | 83402967 | 84252180 |
| 11789 | 5 | 83402967 | 84253030 |
| 11790 | 5 | 83402967 | 84254208 |
| 11791 | 5 | 83402967 | 84314930 |
| 11792 | 5 | 83402967 | 84340523 |
| 11793 | 5 | 83402967 | 84516340 |
| 11794 | 5 | 83402967 | 84706916 |
| 11795 | 5 | 83402967 | 84799488 |
| 11796 | 5 | 83402967 | 84801081 |
| 11797 | 5 | 83402967 | 84824103 |
| 11798 | 5 | 83402967 | 84824203 |
| 11799 | 5 | 83402967 | 84824816 |
| 11800 | 5 | 83402967 | 84825422 |
| 11801 | 5 | 83402967 | 84825763 |
| 11802 | 5 | 83402967 | 84825942 |
| 11803 | 5 | 83402967 | 84843411 |
| 11804 | 5 | 83402967 | 84936441 |
| 11805 | 5 | 83402967 | 84936493 |
| 11806 | 5 | 83402967 | 84943705 |
| 11807 | 5 | 83402967 | 169454950 |
| 11808 | 5 | 83402967 | 181522829 |
| 11809 | 5 | 83402967 | 204759879 |
| 11810 | 5 | 83402967 | 209874191 |
| 11811 | 5 | 83435480 | 83437132 |
| 11812 | 5 | 83435480 | 83522252 |
| 11813 | 5 | 83435480 | 83560095 |
| 11814 | 5 | 83435480 | 83560204 |
| 11815 | 5 | 83435480 | 83572400 |
| 11816 | 5 | 83435480 | 83607661 |
| 11817 | 5 | 83435480 | 83745342 |
| 11818 | 5 | 83435480 | 83861275 |
| 11819 | 5 | 83435480 | 83861633 |
| 11820 | 5 | 83435480 | 83865653 |
| 11821 | 5 | 83435480 | 83865914 |
| 11822 | 5 | 83435480 | 83865920 |
| 11823 | 5 | 83435480 | 83868010 |
| 11824 | 5 | 83435480 | 84019752 |
| 11825 | 5 | 83435480 | 84065912 |
| 11826 | 5 | 83435480 | 84086632 |
| 11827 | 5 | 83435480 | 84089603 |
| 11828 | 5 | 83435480 | 84104814 |
| 11829 | 5 | 83435480 | 84105175 |
| 11830 | 5 | 83435480 | 84251635 |
| 11831 | 5 | 83435480 | 84252180 |
| 11832 | 5 | 83435480 | 84253030 |
| 11833 | 5 | 83435480 | 84254208 |
| 11834 | 5 | 83435480 | 84314930 |
| 11835 | 5 | 83435480 | 84340523 |
| 11836 | 5 | 83435480 | 84516340 |
| 11837 | 5 | 83435480 | 84706916 |
| 11838 | 5 | 83435480 | 84799488 |
| 11839 | 5 | 83435480 | 84801081 |
| 11840 | 5 | 83435480 | 84824103 |
| 11841 | 5 | 83435480 | 84824203 |
| 11842 | 5 | 83435480 | 84824816 |
| 11843 | 5 | 83435480 | 84825422 |
| 11844 | 5 | 83435480 | 84825763 |
| 11845 | 5 | 83435480 | 84825942 |
| 11846 | 5 | 83435480 | 84843411 |
| 11847 | 5 | 83435480 | 84936441 |
| 11848 | 5 | 83435480 | 84936493 |
| 11849 | 5 | 83435480 | 84943705 |
| 11850 | 5 | 83435480 | 169454950 |
| 11851 | 5 | 83435480 | 181522829 |
| 11852 | 5 | 83435480 | 204759879 |
| 11853 | 5 | 83435480 | 209874191 |
| 11854 | 5 | 83521923 | 83522252 |
| 11855 | 5 | 83521923 | 83560095 |
| 11856 | 5 | 83521923 | 83560204 |
| 11857 | 5 | 83521923 | 83572400 |
| 11858 | 5 | 83521923 | 83607661 |
| 11859 | 5 | 83521923 | 83745342 |
| 11860 | 5 | 83521923 | 83861275 |
| 11861 | 5 | 83521923 | 83861633 |
| 11862 | 5 | 83521923 | 83865653 |
| 11863 | 5 | 83521923 | 83865914 |
| 11864 | 5 | 83521923 | 83865920 |
| 11865 | 5 | 83521923 | 83868010 |
| 11866 | 5 | 83521923 | 84019752 |
| 11867 | 5 | 83521923 | 84065912 |
| 11868 | 5 | 83521923 | 84086632 |
| 11869 | 5 | 83521923 | 84089603 |
| 11870 | 5 | 83521923 | 84104814 |
| 11871 | 5 | 83521923 | 84105175 |
| 11872 | 5 | 83521923 | 84251635 |
| 11873 | 5 | 83521923 | 84252180 |
| 11874 | 5 | 83521923 | 84253030 |
| 11875 | 5 | 83521923 | 84254208 |
| 11876 | 5 | 83521923 | 84314930 |
| 11877 | 5 | 83521923 | 84340523 |
| 11878 | 5 | 83521923 | 84516340 |
| 11879 | 5 | 83521923 | 84706916 |
| 11880 | 5 | 83521923 | 84799488 |
| 11881 | 5 | 83521923 | 84801081 |
| 11882 | 5 | 83521923 | 84824103 |
| 11883 | 5 | 83521923 | 84824203 |
| 11884 | 5 | 83521923 | 84824816 |
| 11885 | 5 | 83521923 | 84825422 |
| 11886 | 5 | 83521923 | 84825763 |
| 11887 | 5 | 83521923 | 84825942 |
| 11888 | 5 | 83521923 | 84843411 |
| 11889 | 5 | 83521923 | 84936441 |
| 11890 | 5 | 83521923 | 84936493 |

TABLE 1-continued

Examples of chromosomal segments associated with increased fertility in maize.

| Chromosomal Segment | Chr. | Boundary 1 | Boundary 2 |
|---|---|---|---|
| 11891 | 5 | 83521923 | 84943705 |
| 11892 | 5 | 83521923 | 169454950 |
| 11893 | 5 | 83521923 | 181522829 |
| 11894 | 5 | 83521923 | 204759879 |
| 11895 | 5 | 83521923 | 209874191 |
| 11896 | 5 | 83557023 | 83560095 |
| 11897 | 5 | 83557023 | 83560204 |
| 11898 | 5 | 83557023 | 83572400 |
| 11899 | 5 | 83557023 | 83607661 |
| 11900 | 5 | 83557023 | 83745342 |
| 11901 | 5 | 83557023 | 83861275 |
| 11902 | 5 | 83557023 | 83861633 |
| 11903 | 5 | 83557023 | 83865653 |
| 11904 | 5 | 83557023 | 83865914 |
| 11905 | 5 | 83557023 | 83865920 |
| 11906 | 5 | 83557023 | 83868010 |
| 11907 | 5 | 83557023 | 84019752 |
| 11908 | 5 | 83557023 | 84065912 |
| 11909 | 5 | 83557023 | 84086632 |
| 11910 | 5 | 83557023 | 84089603 |
| 11911 | 5 | 83557023 | 84104814 |
| 11912 | 5 | 83557023 | 84105175 |
| 11913 | 5 | 83557023 | 84251635 |
| 11914 | 5 | 83557023 | 84252180 |
| 11915 | 5 | 83557023 | 84253030 |
| 11916 | 5 | 83557023 | 84254208 |
| 11917 | 5 | 83557023 | 84314930 |
| 11918 | 5 | 83557023 | 84340523 |
| 11919 | 5 | 83557023 | 84516340 |
| 11920 | 5 | 83557023 | 84706916 |
| 11921 | 5 | 83557023 | 84799488 |
| 11922 | 5 | 83557023 | 84801081 |
| 11923 | 5 | 83557023 | 84824103 |
| 11924 | 5 | 83557023 | 84824203 |
| 11925 | 5 | 83557023 | 84824816 |
| 11926 | 5 | 83557023 | 84825422 |
| 11927 | 5 | 83557023 | 84825763 |
| 11928 | 5 | 83557023 | 84825942 |
| 11929 | 5 | 83557023 | 84843411 |
| 11930 | 5 | 83557023 | 84936441 |
| 11931 | 5 | 83557023 | 84936493 |
| 11932 | 5 | 83557023 | 84943705 |
| 11933 | 5 | 83557023 | 169454950 |
| 11934 | 5 | 83557023 | 181522829 |
| 11935 | 5 | 83557023 | 204759879 |
| 11936 | 5 | 83557023 | 209874191 |
| 11937 | 5 | 83560204 | 83567769 |
| 11938 | 5 | 83560204 | 83572400 |
| 11939 | 5 | 83560204 | 83607661 |
| 11940 | 5 | 83560204 | 83745342 |
| 11941 | 5 | 83560204 | 83861275 |
| 11942 | 5 | 83560204 | 83861633 |
| 11943 | 5 | 83560204 | 83865653 |
| 11944 | 5 | 83560204 | 83865914 |
| 11945 | 5 | 83560204 | 83865920 |
| 11946 | 5 | 83560204 | 83868010 |
| 11947 | 5 | 83560204 | 84019752 |
| 11948 | 5 | 83560204 | 84065912 |
| 11949 | 5 | 83560204 | 84086632 |
| 11950 | 5 | 83560204 | 84089603 |
| 11951 | 5 | 83560204 | 84104814 |
| 11952 | 5 | 83560204 | 84105175 |
| 11953 | 5 | 83560204 | 84251635 |
| 11954 | 5 | 83560204 | 84252180 |
| 11955 | 5 | 83560204 | 84253030 |
| 11956 | 5 | 83560204 | 84254208 |
| 11957 | 5 | 83560204 | 84314930 |
| 11958 | 5 | 83560204 | 84340523 |
| 11959 | 5 | 83560204 | 84516340 |
| 11960 | 5 | 83560204 | 84706916 |
| 11961 | 5 | 83560204 | 84799488 |
| 11962 | 5 | 83560204 | 84801081 |
| 11963 | 5 | 83560204 | 84824103 |
| 11964 | 5 | 83560204 | 84824203 |
| 11965 | 5 | 83560204 | 84824816 |
| 11966 | 5 | 83560204 | 84825422 |
| 11967 | 5 | 83560204 | 84825763 |
| 11968 | 5 | 83560204 | 84825942 |
| 11969 | 5 | 83560204 | 84843411 |
| 11970 | 5 | 83560204 | 84936441 |
| 11971 | 5 | 83560204 | 84936493 |
| 11972 | 5 | 83560204 | 84943705 |
| 11973 | 5 | 83560204 | 169454950 |
| 11974 | 5 | 83560204 | 181522829 |
| 11975 | 5 | 83560204 | 204759879 |
| 11976 | 5 | 83560204 | 209874191 |
| 11977 | 5 | 83567769 | 83572400 |
| 11978 | 5 | 83567769 | 83607661 |
| 11979 | 5 | 83567769 | 83745342 |
| 11980 | 5 | 83567769 | 83861275 |
| 11981 | 5 | 83567769 | 83861633 |
| 11982 | 5 | 83567769 | 83865653 |
| 11983 | 5 | 83567769 | 83865914 |
| 11984 | 5 | 83567769 | 83865920 |
| 11985 | 5 | 83567769 | 83868010 |
| 11986 | 5 | 83567769 | 84019752 |
| 11987 | 5 | 83567769 | 84065912 |
| 11988 | 5 | 83567769 | 84086632 |
| 11989 | 5 | 83567769 | 84089603 |
| 11990 | 5 | 83567769 | 84104814 |
| 11991 | 5 | 83567769 | 84105175 |
| 11992 | 5 | 83567769 | 84251635 |
| 11993 | 5 | 83567769 | 84252180 |
| 11994 | 5 | 83567769 | 84253030 |
| 11995 | 5 | 83567769 | 84254208 |
| 11996 | 5 | 83567769 | 84314930 |
| 11997 | 5 | 83567769 | 84340523 |
| 11998 | 5 | 83567769 | 84516340 |
| 11999 | 5 | 83567769 | 84706916 |
| 12000 | 5 | 83567769 | 84799488 |
| 12001 | 5 | 83567769 | 84801081 |
| 12002 | 5 | 83567769 | 84824103 |
| 12003 | 5 | 83567769 | 84824203 |
| 12004 | 5 | 83567769 | 84824816 |
| 12005 | 5 | 83567769 | 84825422 |
| 12006 | 5 | 83567769 | 84825763 |
| 12007 | 5 | 83567769 | 84825942 |
| 12008 | 5 | 83567769 | 84843411 |
| 12009 | 5 | 83567769 | 84936441 |
| 12010 | 5 | 83567769 | 84936493 |
| 12011 | 5 | 83567769 | 84943705 |
| 12012 | 5 | 83567769 | 169454950 |
| 12013 | 5 | 83567769 | 181522829 |
| 12014 | 5 | 83567769 | 204759879 |
| 12015 | 5 | 83567769 | 209874191 |
| 12016 | 5 | 83606990 | 83607661 |
| 12017 | 5 | 83606990 | 83745342 |
| 12018 | 5 | 83606990 | 83861275 |
| 12019 | 5 | 83606990 | 83861633 |
| 12020 | 5 | 83606990 | 83865653 |
| 12021 | 5 | 83606990 | 83865914 |
| 12022 | 5 | 83606990 | 83865920 |
| 12023 | 5 | 83606990 | 83868010 |
| 12024 | 5 | 83606990 | 84019752 |
| 12025 | 5 | 83606990 | 84065912 |
| 12026 | 5 | 83606990 | 84086632 |
| 12027 | 5 | 83606990 | 84089603 |
| 12028 | 5 | 83606990 | 84104814 |
| 12029 | 5 | 83606990 | 84105175 |
| 12030 | 5 | 83606990 | 84251635 |
| 12031 | 5 | 83606990 | 84252180 |
| 12032 | 5 | 83606990 | 84253030 |
| 12033 | 5 | 83606990 | 84254208 |
| 12034 | 5 | 83606990 | 84314930 |
| 12035 | 5 | 83606990 | 84340523 |
| 12036 | 5 | 83606990 | 84516340 |
| 12037 | 5 | 83606990 | 84706916 |
| 12038 | 5 | 83606990 | 84799488 |

TABLE 1-continued

Examples of chromosomal segments associated with increased fertility in maize.

| Chromosomal Segment | Chr. | Boundary 1 | Boundary 2 |
|---|---|---|---|
| 12039 | 5 | 83606990 | 84801081 |
| 12040 | 5 | 83606990 | 84824103 |
| 12041 | 5 | 83606990 | 84824203 |
| 12042 | 5 | 83606990 | 84824816 |
| 12043 | 5 | 83606990 | 84825422 |
| 12044 | 5 | 83606990 | 84825763 |
| 12045 | 5 | 83606990 | 84825942 |
| 12046 | 5 | 83606990 | 84843411 |
| 12047 | 5 | 83606990 | 84936441 |
| 12048 | 5 | 83606990 | 84936493 |
| 12049 | 5 | 83606990 | 84943705 |
| 12050 | 5 | 83606990 | 169454950 |
| 12051 | 5 | 83606990 | 181522829 |
| 12052 | 5 | 83606990 | 204759879 |
| 12053 | 5 | 83606990 | 209874191 |
| 12054 | 5 | 83743980 | 83745342 |
| 12055 | 5 | 83743980 | 83861275 |
| 12056 | 5 | 83743980 | 83861633 |
| 12057 | 5 | 83743980 | 83865653 |
| 12058 | 5 | 83743980 | 83865914 |
| 12059 | 5 | 83743980 | 83865920 |
| 12060 | 5 | 83743980 | 83868010 |
| 12061 | 5 | 83743980 | 84019752 |
| 12062 | 5 | 83743980 | 84065912 |
| 12063 | 5 | 83743980 | 84086632 |
| 12064 | 5 | 83743980 | 84089603 |
| 12065 | 5 | 83743980 | 84104814 |
| 12066 | 5 | 83743980 | 84105175 |
| 12067 | 5 | 83743980 | 84251635 |
| 12068 | 5 | 83743980 | 84252180 |
| 12069 | 5 | 83743980 | 84253030 |
| 12070 | 5 | 83743980 | 84254208 |
| 12071 | 5 | 83743980 | 84314930 |
| 12072 | 5 | 83743980 | 84340523 |
| 12073 | 5 | 83743980 | 84516340 |
| 12074 | 5 | 83743980 | 84706916 |
| 12075 | 5 | 83743980 | 84799488 |
| 12076 | 5 | 83743980 | 84801081 |
| 12077 | 5 | 83743980 | 84824103 |
| 12078 | 5 | 83743980 | 84824203 |
| 12079 | 5 | 83743980 | 84824816 |
| 12080 | 5 | 83743980 | 84825422 |
| 12081 | 5 | 83743980 | 84825763 |
| 12082 | 5 | 83743980 | 84825942 |
| 12083 | 5 | 83743980 | 84843411 |
| 12084 | 5 | 83743980 | 84936441 |
| 12085 | 5 | 83743980 | 84936493 |
| 12086 | 5 | 83743980 | 84943705 |
| 12087 | 5 | 83743980 | 169454950 |
| 12088 | 5 | 83743980 | 181522829 |
| 12089 | 5 | 83743980 | 204759879 |
| 12090 | 5 | 83743980 | 209874191 |
| 12091 | 5 | 83859479 | 83861275 |
| 12092 | 5 | 83859479 | 83861633 |
| 12093 | 5 | 83859479 | 83865653 |
| 12094 | 5 | 83859479 | 83865914 |
| 12095 | 5 | 83859479 | 83865920 |
| 12096 | 5 | 83859479 | 83868010 |
| 12097 | 5 | 83859479 | 84019752 |
| 12098 | 5 | 83859479 | 84065912 |
| 12099 | 5 | 83859479 | 84086632 |
| 12100 | 5 | 83859479 | 84089603 |
| 12101 | 5 | 83859479 | 84104814 |
| 12102 | 5 | 83859479 | 84105175 |
| 12103 | 5 | 83859479 | 84251635 |
| 12104 | 5 | 83859479 | 84252180 |
| 12105 | 5 | 83859479 | 84253030 |
| 12106 | 5 | 83859479 | 84254208 |
| 12107 | 5 | 83859479 | 84314930 |
| 12108 | 5 | 83859479 | 84340523 |
| 12109 | 5 | 83859479 | 84516340 |
| 12110 | 5 | 83859479 | 84706916 |
| 12111 | 5 | 83859479 | 84799488 |
| 12112 | 5 | 83859479 | 84801081 |
| 12113 | 5 | 83859479 | 84824103 |
| 12114 | 5 | 83859479 | 84824203 |
| 12115 | 5 | 83859479 | 84824816 |
| 12116 | 5 | 83859479 | 84825422 |
| 12117 | 5 | 83859479 | 84825763 |
| 12118 | 5 | 83859479 | 84825942 |
| 12119 | 5 | 83859479 | 84843411 |
| 12120 | 5 | 83859479 | 84936441 |
| 12121 | 5 | 83859479 | 84936493 |
| 12122 | 5 | 83859479 | 84943705 |
| 12123 | 5 | 83859479 | 169454950 |
| 12124 | 5 | 83859479 | 181522829 |
| 12125 | 5 | 83859479 | 204759879 |
| 12126 | 5 | 83859479 | 209874191 |
| 12127 | 5 | 83860797 | 83865653 |
| 12128 | 5 | 83860797 | 83865914 |
| 12129 | 5 | 83860797 | 83865920 |
| 12130 | 5 | 83860797 | 83868010 |
| 12131 | 5 | 83860797 | 84019752 |
| 12132 | 5 | 83860797 | 84065912 |
| 12133 | 5 | 83860797 | 84086632 |
| 12134 | 5 | 83860797 | 84089603 |
| 12135 | 5 | 83860797 | 84104814 |
| 12136 | 5 | 83860797 | 84105175 |
| 12137 | 5 | 83860797 | 84251635 |
| 12138 | 5 | 83860797 | 84252180 |
| 12139 | 5 | 83860797 | 84253030 |
| 12140 | 5 | 83860797 | 84254208 |
| 12141 | 5 | 83860797 | 84314930 |
| 12142 | 5 | 83860797 | 84340523 |
| 12143 | 5 | 83860797 | 84516340 |
| 12144 | 5 | 83860797 | 84706916 |
| 12145 | 5 | 83860797 | 84799488 |
| 12146 | 5 | 83860797 | 84801081 |
| 12147 | 5 | 83860797 | 84824103 |
| 12148 | 5 | 83860797 | 84824203 |
| 12149 | 5 | 83860797 | 84824816 |
| 12150 | 5 | 83860797 | 84825422 |
| 12151 | 5 | 83860797 | 84825763 |
| 12152 | 5 | 83860797 | 84825942 |
| 12153 | 5 | 83860797 | 84843411 |
| 12154 | 5 | 83860797 | 84936441 |
| 12155 | 5 | 83860797 | 84936493 |
| 12156 | 5 | 83860797 | 84943705 |
| 12157 | 5 | 83860797 | 169454950 |
| 12158 | 5 | 83860797 | 181522829 |
| 12159 | 5 | 83860797 | 204759879 |
| 12160 | 5 | 83860797 | 209874191 |
| 12161 | 5 | 83861275 | 83861394 |
| 12162 | 5 | 83861275 | 83865653 |
| 12163 | 5 | 83861275 | 83865914 |
| 12164 | 5 | 83861275 | 83865920 |
| 12165 | 5 | 83861275 | 83868010 |
| 12166 | 5 | 83861275 | 84019752 |
| 12167 | 5 | 83861275 | 84065912 |
| 12168 | 5 | 83861275 | 84086632 |
| 12169 | 5 | 83861275 | 84089603 |
| 12170 | 5 | 83861275 | 84104814 |
| 12171 | 5 | 83861275 | 84105175 |
| 12172 | 5 | 83861275 | 84251635 |
| 12173 | 5 | 83861275 | 84252180 |
| 12174 | 5 | 83861275 | 84253030 |
| 12175 | 5 | 83861275 | 84254208 |
| 12176 | 5 | 83861275 | 84314930 |
| 12177 | 5 | 83861275 | 84340523 |
| 12178 | 5 | 83861275 | 84516340 |
| 12179 | 5 | 83861275 | 84706916 |
| 12180 | 5 | 83861275 | 84799488 |
| 12181 | 5 | 83861275 | 84801081 |
| 12182 | 5 | 83861275 | 84824103 |
| 12183 | 5 | 83861275 | 84824203 |
| 12184 | 5 | 83861275 | 84824816 |
| 12185 | 5 | 83861275 | 84825422 |
| 12186 | 5 | 83861275 | 84825763 |

TABLE 1-continued

Examples of chromosomal segments associated with increased fertility in maize.

| Chromosomal Segment | Chr. | Boundary 1 | Boundary 2 |
|---|---|---|---|
| 12187 | 5 | 83861275 | 84825942 |
| 12188 | 5 | 83861275 | 84843411 |
| 12189 | 5 | 83861275 | 84936441 |
| 12190 | 5 | 83861275 | 84936493 |
| 12191 | 5 | 83861275 | 84943705 |
| 12192 | 5 | 83861275 | 169454950 |
| 12193 | 5 | 83861275 | 181522829 |
| 12194 | 5 | 83861275 | 204759879 |
| 12195 | 5 | 83861275 | 209874191 |
| 12196 | 5 | 83861394 | 83865653 |
| 12197 | 5 | 83861394 | 83865914 |
| 12198 | 5 | 83861394 | 83865920 |
| 12199 | 5 | 83861394 | 83868010 |
| 12200 | 5 | 83861394 | 84019752 |
| 12201 | 5 | 83861394 | 84065912 |
| 12202 | 5 | 83861394 | 84086632 |
| 12203 | 5 | 83861394 | 84089603 |
| 12204 | 5 | 83861394 | 84104814 |
| 12205 | 5 | 83861394 | 84105175 |
| 12206 | 5 | 83861394 | 84251635 |
| 12207 | 5 | 83861394 | 84252180 |
| 12208 | 5 | 83861394 | 84253030 |
| 12209 | 5 | 83861394 | 84254208 |
| 12210 | 5 | 83861394 | 84314930 |
| 12211 | 5 | 83861394 | 84340523 |
| 12212 | 5 | 83861394 | 84516340 |
| 12213 | 5 | 83861394 | 84706916 |
| 12214 | 5 | 83861394 | 84799488 |
| 12215 | 5 | 83861394 | 84801081 |
| 12216 | 5 | 83861394 | 84824103 |
| 12217 | 5 | 83861394 | 84824203 |
| 12218 | 5 | 83861394 | 84824816 |
| 12219 | 5 | 83861394 | 84825422 |
| 12220 | 5 | 83861394 | 84825763 |
| 12221 | 5 | 83861394 | 84825942 |
| 12222 | 5 | 83861394 | 84843411 |
| 12223 | 5 | 83861394 | 84936441 |
| 12224 | 5 | 83861394 | 84936493 |
| 12225 | 5 | 83861394 | 84943705 |
| 12226 | 5 | 83861394 | 169454950 |
| 12227 | 5 | 83861394 | 181522829 |
| 12228 | 5 | 83861394 | 204759879 |
| 12229 | 5 | 83861394 | 209874191 |
| 12230 | 5 | 83864692 | 83865653 |
| 12231 | 5 | 83864692 | 83865914 |
| 12232 | 5 | 83864692 | 83865920 |
| 12233 | 5 | 83864692 | 83868010 |
| 12234 | 5 | 83864692 | 84019752 |
| 12235 | 5 | 83864692 | 84065912 |
| 12236 | 5 | 83864692 | 84086632 |
| 12237 | 5 | 83864692 | 84089603 |
| 12238 | 5 | 83864692 | 84104814 |
| 12239 | 5 | 83864692 | 84105175 |
| 12240 | 5 | 83864692 | 84251635 |
| 12241 | 5 | 83864692 | 84252180 |
| 12242 | 5 | 83864692 | 84253030 |
| 12243 | 5 | 83864692 | 84254208 |
| 12244 | 5 | 83864692 | 84314930 |
| 12245 | 5 | 83864692 | 84340523 |
| 12246 | 5 | 83864692 | 84516340 |
| 12247 | 5 | 83864692 | 84706916 |
| 12248 | 5 | 83864692 | 84799488 |
| 12249 | 5 | 83864692 | 84801081 |
| 12250 | 5 | 83864692 | 84824103 |
| 12251 | 5 | 83864692 | 84824203 |
| 12252 | 5 | 83864692 | 84824816 |
| 12253 | 5 | 83864692 | 84825422 |
| 12254 | 5 | 83864692 | 84825763 |
| 12255 | 5 | 83864692 | 84825942 |
| 12256 | 5 | 83864692 | 84843411 |
| 12257 | 5 | 83864692 | 84936441 |
| 12258 | 5 | 83864692 | 84936493 |
| 12259 | 5 | 83864692 | 84943705 |
| 12260 | 5 | 83864692 | 169454950 |
| 12261 | 5 | 83864692 | 181522829 |
| 12262 | 5 | 83864692 | 204759879 |
| 12263 | 5 | 83864692 | 209874191 |
| 12264 | 5 | 83867332 | 83868010 |
| 12265 | 5 | 83867332 | 84019752 |
| 12266 | 5 | 83867332 | 84065912 |
| 12267 | 5 | 83867332 | 84086632 |
| 12268 | 5 | 83867332 | 84089603 |
| 12269 | 5 | 83867332 | 84104814 |
| 12270 | 5 | 83867332 | 84105175 |
| 12271 | 5 | 83867332 | 84251635 |
| 12272 | 5 | 83867332 | 84252180 |
| 12273 | 5 | 83867332 | 84253030 |
| 12274 | 5 | 83867332 | 84254208 |
| 12275 | 5 | 83867332 | 84314930 |
| 12276 | 5 | 83867332 | 84340523 |
| 12277 | 5 | 83867332 | 84516340 |
| 12278 | 5 | 83867332 | 84706916 |
| 12279 | 5 | 83867332 | 84799488 |
| 12280 | 5 | 83867332 | 84801081 |
| 12281 | 5 | 83867332 | 84824103 |
| 12282 | 5 | 83867332 | 84824203 |
| 12283 | 5 | 83867332 | 84824816 |
| 12284 | 5 | 83867332 | 84825422 |
| 12285 | 5 | 83867332 | 84825763 |
| 12286 | 5 | 83867332 | 84825942 |
| 12287 | 5 | 83867332 | 84843411 |
| 12288 | 5 | 83867332 | 84936441 |
| 12289 | 5 | 83867332 | 84936493 |
| 12290 | 5 | 83867332 | 84943705 |
| 12291 | 5 | 83867332 | 169454950 |
| 12292 | 5 | 83867332 | 181522829 |
| 12293 | 5 | 83867332 | 204759879 |
| 12294 | 5 | 83867332 | 209874191 |
| 12295 | 5 | 84018779 | 84019752 |
| 12296 | 5 | 84018779 | 84065912 |
| 12297 | 5 | 84018779 | 84086632 |
| 12298 | 5 | 84018779 | 84089603 |
| 12299 | 5 | 84018779 | 84104814 |
| 12300 | 5 | 84018779 | 84105175 |
| 12301 | 5 | 84018779 | 84251635 |
| 12302 | 5 | 84018779 | 84252180 |
| 12303 | 5 | 84018779 | 84253030 |
| 12304 | 5 | 84018779 | 84254208 |
| 12305 | 5 | 84018779 | 84314930 |
| 12306 | 5 | 84018779 | 84340523 |
| 12307 | 5 | 84018779 | 84516340 |
| 12308 | 5 | 84018779 | 84706916 |
| 12309 | 5 | 84018779 | 84799488 |
| 12310 | 5 | 84018779 | 84801081 |
| 12311 | 5 | 84018779 | 84824103 |
| 12312 | 5 | 84018779 | 84824203 |
| 12313 | 5 | 84018779 | 84824816 |
| 12314 | 5 | 84018779 | 84825422 |
| 12315 | 5 | 84018779 | 84825763 |
| 12316 | 5 | 84018779 | 84825942 |
| 12317 | 5 | 84018779 | 84843411 |
| 12318 | 5 | 84018779 | 84936441 |
| 12319 | 5 | 84018779 | 84936493 |
| 12320 | 5 | 84018779 | 84943705 |
| 12321 | 5 | 84018779 | 169454950 |
| 12322 | 5 | 84018779 | 181522829 |
| 12323 | 5 | 84018779 | 204759879 |
| 12324 | 5 | 84018779 | 209874191 |
| 12325 | 5 | 84061561 | 84065912 |
| 12326 | 5 | 84061561 | 84086632 |
| 12327 | 5 | 84061561 | 84089603 |
| 12328 | 5 | 84061561 | 84104814 |
| 12329 | 5 | 84061561 | 84105175 |
| 12330 | 5 | 84061561 | 84251635 |
| 12331 | 5 | 84061561 | 84252180 |
| 12332 | 5 | 84061561 | 84253030 |
| 12333 | 5 | 84061561 | 84254208 |
| 12334 | 5 | 84061561 | 84314930 |

TABLE 1-continued

Examples of chromosomal segments associated with increased fertility in maize.

| Chromosomal Segment | Chr. | Boundary 1 | Boundary 2 |
|---|---|---|---|
| 12335 | 5 | 84061561 | 84340523 |
| 12336 | 5 | 84061561 | 84516340 |
| 12337 | 5 | 84061561 | 84706916 |
| 12338 | 5 | 84061561 | 84799488 |
| 12339 | 5 | 84061561 | 84801081 |
| 12340 | 5 | 84061561 | 84824103 |
| 12341 | 5 | 84061561 | 84824203 |
| 12342 | 5 | 84061561 | 84824816 |
| 12343 | 5 | 84061561 | 84825422 |
| 12344 | 5 | 84061561 | 84825763 |
| 12345 | 5 | 84061561 | 84825942 |
| 12346 | 5 | 84061561 | 84843411 |
| 12347 | 5 | 84061561 | 84936441 |
| 12348 | 5 | 84061561 | 84936493 |
| 12349 | 5 | 84061561 | 84943705 |
| 12350 | 5 | 84061561 | 169454950 |
| 12351 | 5 | 84061561 | 181522829 |
| 12352 | 5 | 84061561 | 204759879 |
| 12353 | 5 | 84061561 | 209874191 |
| 12354 | 5 | 84083388 | 84086632 |
| 12355 | 5 | 84083388 | 84089603 |
| 12356 | 5 | 84083388 | 84104814 |
| 12357 | 5 | 84083388 | 84105175 |
| 12358 | 5 | 84083388 | 84251635 |
| 12359 | 5 | 84083388 | 84252180 |
| 12360 | 5 | 84083388 | 84253030 |
| 12361 | 5 | 84083388 | 84254208 |
| 12362 | 5 | 84083388 | 84314930 |
| 12363 | 5 | 84083388 | 84340523 |
| 12364 | 5 | 84083388 | 84516340 |
| 12365 | 5 | 84083388 | 84706916 |
| 12366 | 5 | 84083388 | 84799488 |
| 12367 | 5 | 84083388 | 84801081 |
| 12368 | 5 | 84083388 | 84824103 |
| 12369 | 5 | 84083388 | 84824203 |
| 12370 | 5 | 84083388 | 84824816 |
| 12371 | 5 | 84083388 | 84825422 |
| 12372 | 5 | 84083388 | 84825763 |
| 12373 | 5 | 84083388 | 84825942 |
| 12374 | 5 | 84083388 | 84843411 |
| 12375 | 5 | 84083388 | 84936441 |
| 12376 | 5 | 84083388 | 84936493 |
| 12377 | 5 | 84083388 | 84943705 |
| 12378 | 5 | 84083388 | 169454950 |
| 12379 | 5 | 84083388 | 181522829 |
| 12380 | 5 | 84083388 | 204759879 |
| 12381 | 5 | 84083388 | 209874191 |
| 12382 | 5 | 84088707 | 84089603 |
| 12383 | 5 | 84088707 | 84104814 |
| 12384 | 5 | 84088707 | 84105175 |
| 12385 | 5 | 84088707 | 84251635 |
| 12386 | 5 | 84088707 | 84252180 |
| 12387 | 5 | 84088707 | 84253030 |
| 12388 | 5 | 84088707 | 84254208 |
| 12389 | 5 | 84088707 | 84314930 |
| 12390 | 5 | 84088707 | 84340523 |
| 12391 | 5 | 84088707 | 84516340 |
| 12392 | 5 | 84088707 | 84706916 |
| 12393 | 5 | 84088707 | 84799488 |
| 12394 | 5 | 84088707 | 84801081 |
| 12395 | 5 | 84088707 | 84824103 |
| 12396 | 5 | 84088707 | 84824203 |
| 12397 | 5 | 84088707 | 84824816 |
| 12398 | 5 | 84088707 | 84825422 |
| 12399 | 5 | 84088707 | 84825763 |
| 12400 | 5 | 84088707 | 84825942 |
| 12401 | 5 | 84088707 | 84843411 |
| 12402 | 5 | 84088707 | 84936441 |
| 12403 | 5 | 84088707 | 84936493 |
| 12404 | 5 | 84088707 | 84943705 |
| 12405 | 5 | 84088707 | 169454950 |
| 12406 | 5 | 84088707 | 181522829 |
| 12407 | 5 | 84088707 | 204759879 |
| 12408 | 5 | 84088707 | 209874191 |
| 12409 | 5 | 84101452 | 84104814 |
| 12410 | 5 | 84101452 | 84105175 |
| 12411 | 5 | 84101452 | 84251635 |
| 12412 | 5 | 84101452 | 84252180 |
| 12413 | 5 | 84101452 | 84253030 |
| 12414 | 5 | 84101452 | 84254208 |
| 12415 | 5 | 84101452 | 84314930 |
| 12416 | 5 | 84101452 | 84340523 |
| 12417 | 5 | 84101452 | 84516340 |
| 12418 | 5 | 84101452 | 84706916 |
| 12419 | 5 | 84101452 | 84799488 |
| 12420 | 5 | 84101452 | 84801081 |
| 12421 | 5 | 84101452 | 84824103 |
| 12422 | 5 | 84101452 | 84824203 |
| 12423 | 5 | 84101452 | 84824816 |
| 12424 | 5 | 84101452 | 84825422 |
| 12425 | 5 | 84101452 | 84825763 |
| 12426 | 5 | 84101452 | 84825942 |
| 12427 | 5 | 84101452 | 84843411 |
| 12428 | 5 | 84101452 | 84936441 |
| 12429 | 5 | 84101452 | 84936493 |
| 12430 | 5 | 84101452 | 84943705 |
| 12431 | 5 | 84101452 | 169454950 |
| 12432 | 5 | 84101452 | 181522829 |
| 12433 | 5 | 84101452 | 204759879 |
| 12434 | 5 | 84101452 | 209874191 |
| 12435 | 5 | 84103364 | 84104814 |
| 12436 | 5 | 84103364 | 84105175 |
| 12437 | 5 | 84103364 | 84251635 |
| 12438 | 5 | 84103364 | 84252180 |
| 12439 | 5 | 84103364 | 84253030 |
| 12440 | 5 | 84103364 | 84254208 |
| 12441 | 5 | 84103364 | 84314930 |
| 12442 | 5 | 84103364 | 84340523 |
| 12443 | 5 | 84103364 | 84516340 |
| 12444 | 5 | 84103364 | 84706916 |
| 12445 | 5 | 84103364 | 84799488 |
| 12446 | 5 | 84103364 | 84801081 |
| 12447 | 5 | 84103364 | 84824103 |
| 12448 | 5 | 84103364 | 84824203 |
| 12449 | 5 | 84103364 | 84824816 |
| 12450 | 5 | 84103364 | 84825422 |
| 12451 | 5 | 84103364 | 84825763 |
| 12452 | 5 | 84103364 | 84825942 |
| 12453 | 5 | 84103364 | 84843411 |
| 12454 | 5 | 84103364 | 84936441 |
| 12455 | 5 | 84103364 | 84936493 |
| 12456 | 5 | 84103364 | 84943705 |
| 12457 | 5 | 84103364 | 169454950 |
| 12458 | 5 | 84103364 | 181522829 |
| 12459 | 5 | 84103364 | 204759879 |
| 12460 | 5 | 84103364 | 209874191 |
| 12461 | 5 | 84248220 | 84251635 |
| 12462 | 5 | 84248220 | 84252180 |
| 12463 | 5 | 84248220 | 84253030 |
| 12464 | 5 | 84248220 | 84254208 |
| 12465 | 5 | 84248220 | 84314930 |
| 12466 | 5 | 84248220 | 84340523 |
| 12467 | 5 | 84248220 | 84516340 |
| 12468 | 5 | 84248220 | 84706916 |
| 12469 | 5 | 84248220 | 84799488 |
| 12470 | 5 | 84248220 | 84801081 |
| 12471 | 5 | 84248220 | 84824103 |
| 12472 | 5 | 84248220 | 84824203 |
| 12473 | 5 | 84248220 | 84824816 |
| 12474 | 5 | 84248220 | 84825422 |
| 12475 | 5 | 84248220 | 84825763 |
| 12476 | 5 | 84248220 | 84825942 |
| 12477 | 5 | 84248220 | 84843411 |
| 12478 | 5 | 84248220 | 84936441 |
| 12479 | 5 | 84248220 | 84936493 |
| 12480 | 5 | 84248220 | 84943705 |
| 12481 | 5 | 84248220 | 169454950 |
| 12482 | 5 | 84248220 | 181522829 |

TABLE 1-continued

Examples of chromosomal segments associated with increased fertility in maize.

| Chromosomal Segment | Chr. | Boundary 1 | Boundary 2 |
|---|---|---|---|
| 12483 | 5 | 84248220 | 204759879 |
| 12484 | 5 | 84248220 | 209874191 |
| 12485 | 5 | 84248224 | 84251635 |
| 12486 | 5 | 84248224 | 84252180 |
| 12487 | 5 | 84248224 | 84253030 |
| 12488 | 5 | 84248224 | 84254208 |
| 12489 | 5 | 84248224 | 84314930 |
| 12490 | 5 | 84248224 | 84340523 |
| 12491 | 5 | 84248224 | 84516340 |
| 12492 | 5 | 84248224 | 84706916 |
| 12493 | 5 | 84248224 | 84799488 |
| 12494 | 5 | 84248224 | 84801081 |
| 12495 | 5 | 84248224 | 84824103 |
| 12496 | 5 | 84248224 | 84824203 |
| 12497 | 5 | 84248224 | 84824816 |
| 12498 | 5 | 84248224 | 84825422 |
| 12499 | 5 | 84248224 | 84825763 |
| 12500 | 5 | 84248224 | 84825942 |
| 12501 | 5 | 84248224 | 84843411 |
| 12502 | 5 | 84248224 | 84936441 |
| 12503 | 5 | 84248224 | 84936493 |
| 12504 | 5 | 84248224 | 84943705 |
| 12505 | 5 | 84248224 | 169454950 |
| 12506 | 5 | 84248224 | 181522829 |
| 12507 | 5 | 84248224 | 204759879 |
| 12508 | 5 | 84248224 | 209874191 |
| 12509 | 5 | 84252053 | 84252180 |
| 12510 | 5 | 84252053 | 84253030 |
| 12511 | 5 | 84252053 | 84254208 |
| 12512 | 5 | 84252053 | 84314930 |
| 12513 | 5 | 84252053 | 84340523 |
| 12514 | 5 | 84252053 | 84516340 |
| 12515 | 5 | 84252053 | 84706916 |
| 12516 | 5 | 84252053 | 84799488 |
| 12517 | 5 | 84252053 | 84801081 |
| 12518 | 5 | 84252053 | 84824103 |
| 12519 | 5 | 84252053 | 84824203 |
| 12520 | 5 | 84252053 | 84824816 |
| 12521 | 5 | 84252053 | 84825422 |
| 12522 | 5 | 84252053 | 84825763 |
| 12523 | 5 | 84252053 | 84825942 |
| 12524 | 5 | 84252053 | 84843411 |
| 12525 | 5 | 84252053 | 84936441 |
| 12526 | 5 | 84252053 | 84936493 |
| 12527 | 5 | 84252053 | 84943705 |
| 12528 | 5 | 84252053 | 169454950 |
| 12529 | 5 | 84252053 | 181522829 |
| 12530 | 5 | 84252053 | 204759879 |
| 12531 | 5 | 84252053 | 209874191 |
| 12532 | 5 | 84253581 | 84254208 |
| 12533 | 5 | 84253581 | 84314930 |
| 12534 | 5 | 84253581 | 84340523 |
| 12535 | 5 | 84253581 | 84516340 |
| 12536 | 5 | 84253581 | 84706916 |
| 12537 | 5 | 84253581 | 84799488 |
| 12538 | 5 | 84253581 | 84801081 |
| 12539 | 5 | 84253581 | 84824103 |
| 12540 | 5 | 84253581 | 84824203 |
| 12541 | 5 | 84253581 | 84824816 |
| 12542 | 5 | 84253581 | 84825422 |
| 12543 | 5 | 84253581 | 84825763 |
| 12544 | 5 | 84253581 | 84825942 |
| 12545 | 5 | 84253581 | 84843411 |
| 12546 | 5 | 84253581 | 84936441 |
| 12547 | 5 | 84253581 | 84936493 |
| 12548 | 5 | 84253581 | 84943705 |
| 12549 | 5 | 84253581 | 169454950 |
| 12550 | 5 | 84253581 | 181522829 |
| 12551 | 5 | 84253581 | 204759879 |
| 12552 | 5 | 84253581 | 209874191 |
| 12553 | 5 | 84314151 | 84314930 |
| 12554 | 5 | 84314151 | 84340523 |
| 12555 | 5 | 84314151 | 84516340 |
| 12556 | 5 | 84314151 | 84706916 |
| 12557 | 5 | 84314151 | 84799488 |
| 12558 | 5 | 84314151 | 84801081 |
| 12559 | 5 | 84314151 | 84824103 |
| 12560 | 5 | 84314151 | 84824203 |
| 12561 | 5 | 84314151 | 84824816 |
| 12562 | 5 | 84314151 | 84825422 |
| 12563 | 5 | 84314151 | 84825763 |
| 12564 | 5 | 84314151 | 84825942 |
| 12565 | 5 | 84314151 | 84843411 |
| 12566 | 5 | 84314151 | 84936441 |
| 12567 | 5 | 84314151 | 84936493 |
| 12568 | 5 | 84314151 | 84943705 |
| 12569 | 5 | 84314151 | 169454950 |
| 12570 | 5 | 84314151 | 181522829 |
| 12571 | 5 | 84314151 | 204759879 |
| 12572 | 5 | 84314151 | 209874191 |
| 12573 | 5 | 84338664 | 84340523 |
| 12574 | 5 | 84338664 | 84516340 |
| 12575 | 5 | 84338664 | 84706916 |
| 12576 | 5 | 84338664 | 84799488 |
| 12577 | 5 | 84338664 | 84801081 |
| 12578 | 5 | 84338664 | 84824103 |
| 12579 | 5 | 84338664 | 84824203 |
| 12580 | 5 | 84338664 | 84824816 |
| 12581 | 5 | 84338664 | 84825422 |
| 12582 | 5 | 84338664 | 84825763 |
| 12583 | 5 | 84338664 | 84825942 |
| 12584 | 5 | 84338664 | 84843411 |
| 12585 | 5 | 84338664 | 84936441 |
| 12586 | 5 | 84338664 | 84936493 |
| 12587 | 5 | 84338664 | 84943705 |
| 12588 | 5 | 84338664 | 169454950 |
| 12589 | 5 | 84338664 | 181522829 |
| 12590 | 5 | 84338664 | 204759879 |
| 12591 | 5 | 84338664 | 209874191 |
| 12592 | 5 | 84516113 | 84516340 |
| 12593 | 5 | 84516113 | 84706916 |
| 12594 | 5 | 84516113 | 84799488 |
| 12595 | 5 | 84516113 | 84801081 |
| 12596 | 5 | 84516113 | 84824103 |
| 12597 | 5 | 84516113 | 84824203 |
| 12598 | 5 | 84516113 | 84824816 |
| 12599 | 5 | 84516113 | 84825422 |
| 12600 | 5 | 84516113 | 84825763 |
| 12601 | 5 | 84516113 | 84825942 |
| 12602 | 5 | 84516113 | 84843411 |
| 12603 | 5 | 84516113 | 84936441 |
| 12604 | 5 | 84516113 | 84936493 |
| 12605 | 5 | 84516113 | 84943705 |
| 12606 | 5 | 84516113 | 169454950 |
| 12607 | 5 | 84516113 | 181522829 |
| 12608 | 5 | 84516113 | 204759879 |
| 12609 | 5 | 84516113 | 209874191 |
| 12610 | 5 | 84706267 | 84706916 |
| 12611 | 5 | 84706267 | 84799488 |
| 12612 | 5 | 84706267 | 84801081 |
| 12613 | 5 | 84706267 | 84824103 |
| 12614 | 5 | 84706267 | 84824203 |
| 12615 | 5 | 84706267 | 84824816 |
| 12616 | 5 | 84706267 | 84825422 |
| 12617 | 5 | 84706267 | 84825763 |
| 12618 | 5 | 84706267 | 84825942 |
| 12619 | 5 | 84706267 | 84843411 |
| 12620 | 5 | 84706267 | 84936441 |
| 12621 | 5 | 84706267 | 84936493 |
| 12622 | 5 | 84706267 | 84943705 |
| 12623 | 5 | 84706267 | 169454950 |
| 12624 | 5 | 84706267 | 181522829 |
| 12625 | 5 | 84706267 | 204759879 |
| 12626 | 5 | 84706267 | 209874191 |
| 12627 | 5 | 84796405 | 84799488 |
| 12628 | 5 | 84796405 | 84801081 |
| 12629 | 5 | 84796405 | 84824103 |
| 12630 | 5 | 84796405 | 84824203 |

TABLE 1-continued

Examples of chromosomal segments associated with increased fertility in maize.

| Chromosomal Segment | Chr. | Boundary 1 | Boundary 2 |
|---|---|---|---|
| 12631 | 5 | 84796405 | 84824816 |
| 12632 | 5 | 84796405 | 84825422 |
| 12633 | 5 | 84796405 | 84825763 |
| 12634 | 5 | 84796405 | 84825942 |
| 12635 | 5 | 84796405 | 84843411 |
| 12636 | 5 | 84796405 | 84936441 |
| 12637 | 5 | 84796405 | 84936493 |
| 12638 | 5 | 84796405 | 84943705 |
| 12639 | 5 | 84796405 | 169454950 |
| 12640 | 5 | 84796405 | 181522829 |
| 12641 | 5 | 84796405 | 204759879 |
| 12642 | 5 | 84796405 | 209874191 |
| 12643 | 5 | 84799805 | 84801081 |
| 12644 | 5 | 84799805 | 84824103 |
| 12645 | 5 | 84799805 | 84824203 |
| 12646 | 5 | 84799805 | 84824816 |
| 12647 | 5 | 84799805 | 84825422 |
| 12648 | 5 | 84799805 | 84825763 |
| 12649 | 5 | 84799805 | 84825942 |
| 12650 | 5 | 84799805 | 84843411 |
| 12651 | 5 | 84799805 | 84936441 |
| 12652 | 5 | 84799805 | 84936493 |
| 12653 | 5 | 84799805 | 84943705 |
| 12654 | 5 | 84799805 | 169454950 |
| 12655 | 5 | 84799805 | 181522829 |
| 12656 | 5 | 84799805 | 204759879 |
| 12657 | 5 | 84799805 | 209874191 |
| 12658 | 5 | 84821810 | 84824103 |
| 12659 | 5 | 84821810 | 84824203 |
| 12660 | 5 | 84821810 | 84824816 |
| 12661 | 5 | 84821810 | 84825422 |
| 12662 | 5 | 84821810 | 84825763 |
| 12663 | 5 | 84821810 | 84825942 |
| 12664 | 5 | 84821810 | 84843411 |
| 12665 | 5 | 84821810 | 84936441 |
| 12666 | 5 | 84821810 | 84936493 |
| 12667 | 5 | 84821810 | 84943705 |
| 12668 | 5 | 84821810 | 169454950 |
| 12669 | 5 | 84821810 | 181522829 |
| 12670 | 5 | 84821810 | 204759879 |
| 12671 | 5 | 84821810 | 209874191 |
| 12672 | 5 | 84822183 | 84824103 |
| 12673 | 5 | 84822183 | 84824203 |
| 12674 | 5 | 84822183 | 84824816 |
| 12675 | 5 | 84822183 | 84825422 |
| 12676 | 5 | 84822183 | 84825763 |
| 12677 | 5 | 84822183 | 84825942 |
| 12678 | 5 | 84822183 | 84843411 |
| 12679 | 5 | 84822183 | 84936441 |
| 12680 | 5 | 84822183 | 84936493 |
| 12681 | 5 | 84822183 | 84943705 |
| 12682 | 5 | 84822183 | 169454950 |
| 12683 | 5 | 84822183 | 181522829 |
| 12684 | 5 | 84822183 | 204759879 |
| 12685 | 5 | 84822183 | 209874191 |
| 12686 | 5 | 84822215 | 84824103 |
| 12687 | 5 | 84822215 | 84824203 |
| 12688 | 5 | 84822215 | 84824816 |
| 12689 | 5 | 84822215 | 84825422 |
| 12690 | 5 | 84822215 | 84825763 |
| 12691 | 5 | 84822215 | 84825942 |
| 12692 | 5 | 84822215 | 84843411 |
| 12693 | 5 | 84822215 | 84936493 |
| 12694 | 5 | 84822215 | 84943705 |
| 12695 | 5 | 84822215 | 169454950 |
| 12696 | 5 | 84822215 | 181522829 |
| 12697 | 5 | 84822215 | 204759879 |
| 12698 | 5 | 84822215 | 209874191 |
| 12699 | 5 | 84824103 | 84824203 |
| 12700 | 5 | 84824103 | 84824816 |
| 12701 | 5 | 84824103 | 84840183 |
| 12702 | 5 | 84824103 | 84843411 |
| 12703 | 5 | 84824103 | 84936441 |
| 12704 | 5 | 84824103 | 84936493 |
| 12705 | 5 | 84824103 | 84943705 |
| 12706 | 5 | 84824103 | 169454950 |
| 12707 | 5 | 84824103 | 181522829 |
| 12708 | 5 | 84824103 | 204759879 |
| 12709 | 5 | 84824103 | 209874191 |
| 12710 | 5 | 84824203 | 84934242 |
| 12711 | 5 | 84824203 | 84936441 |
| 12712 | 5 | 84824203 | 84936493 |
| 12713 | 5 | 84824203 | 84943705 |
| 12714 | 5 | 84824203 | 169454950 |
| 12715 | 5 | 84824203 | 181522829 |
| 12716 | 5 | 84824203 | 204759879 |
| 12717 | 5 | 84824203 | 209874191 |
| 12718 | 5 | 84840183 | 84843411 |
| 12719 | 5 | 84840183 | 84936441 |
| 12720 | 5 | 84840183 | 84936493 |
| 12721 | 5 | 84840183 | 84943705 |
| 12722 | 5 | 84840183 | 169454950 |
| 12723 | 5 | 84840183 | 181522829 |
| 12724 | 5 | 84840183 | 204759879 |
| 12725 | 5 | 84840183 | 209874191 |
| 12726 | 5 | 84934242 | 84936441 |
| 12727 | 5 | 84934242 | 84936493 |
| 12728 | 5 | 84934242 | 84943705 |
| 12729 | 5 | 84934242 | 169454950 |
| 12730 | 5 | 84934242 | 181522829 |
| 12731 | 5 | 84934242 | 204759879 |
| 12732 | 5 | 84934242 | 209874191 |
| 12733 | 5 | 84938287 | 84943705 |
| 12734 | 5 | 84938287 | 169454950 |
| 12735 | 5 | 84938287 | 181522829 |
| 12736 | 5 | 84938287 | 204759879 |
| 12737 | 5 | 84938287 | 209874191 |
| 12738 | 5 | 169454950 | 181522829 |
| 12739 | 5 | 169454950 | 204759879 |
| 12740 | 5 | 169454950 | 209874191 |
| 12741 | 5 | 181522829 | 204759879 |
| 12742 | 5 | 181522829 | 209874191 |
| 12743 | 5 | 204759879 | 209874191 |
| 12744 | 6 | 121671402 | 165317744 |
| 12745 | 6 | 121671402 | 165632140 |
| 12746 | 6 | 121671402 | 167541488 |
| 12747 | 6 | 165317744 | 165632140 |
| 12748 | 6 | 165317744 | 167541488 |
| 12749 | 6 | 165632140 | 167541488 |
| 12750 | 7 | 17293606 | 33157904 |
| 12751 | 7 | 17293606 | 52027945 |
| 12752 | 7 | 17293606 | 134050244 |
| 12753 | 7 | 33157904 | 52027945 |
| 12754 | 7 | 33157904 | 134050244 |
| 12755 | 7 | 52027945 | 134050244 |
| 12756 | 8 | 120061025 | 173714727 |
| 12757 | 9 | 23258800 | 128947590 |
| 12758 | 9 | 23258800 | 145336391 |
| 12759 | 9 | 23258800 | 147896266 |
| 12760 | 9 | 128947590 | 145336391 |
| 12761 | 9 | 128947590 | 147896266 |
| 12762 | 9 | 145336391 | 147896266 |
| 12763 | 10 | 5873450 | 140850928 |
| 12764 | 10 | 5873450 | 142092409 |
| 12765 | 10 | 5873450 | 145273700 |
| 12766 | 10 | 140850928 | 142092409 |
| 12767 | 10 | 140850928 | 145273700 |
| 12768 | 10 | 142092409 | 145273700 |

TABLE 2

Examples of alleles associated with increased fertility in maize.

| Chr. | Position | Desired Allele |
|---|---|---|
| 5 | 77990414 | A |
| 5 | 77990442 | C |
| 5 | 77990478 | T |
| 5 | 77990499 | A |
| 5 | 77990523 | G |
| 5 | 77990545 | A |
| 5 | 77991998 | G |
| 5 | 77995135 | C |
| 5 | 77995150 | A |
| 5 | 77996710 | T |
| 5 | 78310107 | A |
| 5 | 78310132 | T |
| 5 | 78918620 | G |
| 5 | 79531947 | A |
| 5 | 79537908 | G |
| 5 | 79707038 | C |
| 5 | 79707074 | A |
| 5 | 79859447 | A |
| 5 | 79862605 | G |
| 5 | 79862609 | A |
| 5 | 79865888 | T |
| 5 | 79867527 | A |
| 5 | 80236641 | G |
| 5 | 80236734 | T |
| 5 | 80236789 | T |
| 5 | 80236810 | T |
| 5 | 80236933 | T |
| 5 | 80271911 | A |
| 5 | 80279798 | C |
| 5 | 80387964 | C |
| 5 | 80388968 | T |
| 5 | 80389273 | A |
| 5 | 80389290 | C |
| 5 | 80389380 | C |
| 5 | 80389419 | C |
| 5 | 80389432 | A |
| 5 | 80389533 | C |
| 5 | 80804587 | G |
| 5 | 80828757 | C |
| 5 | 80829669 | T |
| 5 | 81267278 | G |
| 5 | 81267320 | T |
| 5 | 81763802 | G |
| 5 | 81763824 | C |
| 5 | 81802220 | A |
| 5 | 81802574 | C |
| 5 | 81950558 | T |
| 5 | 81950582 | T |
| 5 | 82085147 | C |
| 5 | 82087667 | A |
| 5 | 82235558 | A |
| 5 | 82236085 | T |
| 5 | 82236162 | A |
| 5 | 82325775 | C |
| 5 | 82325977 | C |
| 5 | 82326020 | G |
| 5 | 82326037 | G |
| 5 | 82326164 | C |
| 5 | 82326170 | T |
| 5 | 82326175 | T |
| 5 | 82423926 | A |
| 5 | 82424010 | G |
| 5 | 82424392 | A |
| 5 | 82424461 | C |
| 5 | 82424629 | G |
| 5 | 82424695 | C |
| 5 | 82424706 | C |
| 5 | 82424752 | G |
| 5 | 82424773 | G |
| 5 | 82424791 | A |
| 5 | 82425070 | C |
| 5 | 82425098 | C |
| 5 | 82425358 | G |
| 5 | 82443847 | T |
| 5 | 82443957 | T |
| 5 | 82443978 | A/G |
| 5 | 82444245 | T |
| 5 | 82444266 | T |
| 5 | 82444716 | A |
| 5 | 82445340 | A |
| 5 | 82445493 | A |
| 5 | 82446188 | C |
| 5 | 82446660 | G |
| 5 | 82446684 | T |
| 5 | 82446704 | A |
| 5 | 82549380 | C |
| 5 | 82549409 | A |
| 5 | 82549517 | A |
| 5 | 82549554 | C |
| 5 | 82549629 | C |
| 5 | 82549650 | C |
| 5 | 82549724 | C |
| 5 | 82549867 | C |
| 5 | 82549995 | G |
| 5 | 82550364 | C |
| 5 | 82550459 | G |
| 5 | 82550498 | G |
| 5 | 82550853 | T |
| 5 | 82550983 | T |
| 5 | 82551025 | C |
| 5 | 82552120 | T |
| 5 | 82552368 | G |
| 5 | 82553234 | G |
| 5 | 82555338 | A |
| 5 | 83560144 | T |
| 5 | 83560192 | A |
| 5 | 83860601 | T |
| 5 | 83860682 | T |
| 5 | 83861161 | G |
| 5 | 83861215 | A |
| 5 | 83861266 | A |
| 5 | 83861344 | T |
| 5 | 83861361 | T |
| 5 | 84086015 | T |
| 5 | 84796702 | G |
| 5 | 84822534 | G |
| 5 | 84822543 | T |
| 5 | 84823992 | A |
| 5 | 84823998 | C |
| 5 | 84824103 | T |
| 5 | 84824205 | T |
| 5 | 84824447 | C |
| 5 | 84824473 | C |
| 5 | 84824495 | G |
| 5 | 84824561 | G |
| 5 | 84824603 | C |
| 5 | 84824951 | i |
| 5 | 84825014 | C |
| 5 | 84825020 | A |
| 5 | 84825024 | G |
| 5 | 84825087 | C |
| 5 | 84825264 | T |
| 5 | 84825276 | T |
| 5 | 84825303 | C |
| 5 | 84825469 | G |
| 5 | 84825471 | A |
| 5 | 84825480 | C |
| 5 | 84825497 | G |
| 5 | 84825510 | C |
| 5 | 84825512 | A |
| 5 | 84825527 | C |
| 5 | 84825551 | G |
| 5 | 84825588 | G |
| 5 | 84825642 | C |

TABLE 2-continued

Examples of alleles associated with increased fertility in maize.

| Chr. | Position | Desired Allele |
|---|---|---|
| 5 | 84841805 | T |
| 5 | 84842085 | A |
| 5 | 84843056 | A |
| 5 | 84938414 | T |
| 5 | 84938476 | T |
| 5 | 84938528 | T |

TABLE 3

Examples of proteins of interest encoded by maize chromosome 5.

| Protein Identifier | Chr. | Positions | Strand | SEQ ID NO: | SEQ ID NO: | SEQ ID NO: |
|---|---|---|---|---|---|---|
| GRMZM2G435796_P01 | 5 | 78022476-78023096 | − | 1 | 176 | 351 |
| GRMZM5G832780_P01 | 5 | 78129898-78131652 | − | 2 | 177 | 352 |
| GRMZM2G425559_P01 | 5 | 78129898-78131784 | + | 3 | 178 | 353 |
| GRMZM2G006937_P01 | 5 | 78255163-78310499 | + | 4 | 179 | 354 |
| GRMZM2G102912_P01 | 5 | 78380304-78381593 | + | 5 | 180 | 355 |
| GRMZM2G102845_P01 | 5 | 78381834-78389884 | − | 6 | 181 | 356 |
| GRMZM5G865367_P01 | 5 | 78519893-78520683 | + | 7 | 182 | 357 |
| GRMZM2G322493_P01 | 5 | 78758856-78765635 | + | 8 | 183 | 358 |
| GRMZM2G167741_P01 | 5 | 78772058-78780292 | + | 9 | 184 | 359 |
| GRMZM2G410357_P02 | 5 | 78804756-78813114 | + | 10 | 185 | 360 |
| GRMZM2G410357_P01 | 5 | 78804756-78814710 | + | 11 | 186 | 361 |
| GRMZM2G410357_P04 | 5 | 78805059-78815306 | + | 12 | 187 | 362 |
| GRMZM2G410357_P03 | 5 | 78805059-78815306 | + | 13 | 188 | 363 |
| GRMZM2G410357_P05 | 5 | 78805059-78815306 | + | 14 | 189 | 364 |
| GRMZM2G410357_P06 | 5 | 78814424-78814976 | + | 15 | 190 | 365 |
| GRMZM2G410393_P03 | 5 | 78819803-78826528 | + | 16 | 191 | 366 |
| GRMZM2G410393_P04 | 5 | 78819803-78826528 | + | 17 | 192 | 367 |
| GRMZM2G410393_P05 | 5 | 78819803-78826528 | + | 18 | 193 | 368 |
| GRMZM2G410393_P02 | 5 | 78819803-78826538 | + | 19 | 194 | 369 |
| GRMZM2G410393_P01 | 5 | 78819803-78826612 | + | 20 | 195 | 370 |
| AC197118.3_FGP005 | 5 | 78820119-78821393 | − | 21 | 196 | 371 |
| GRMZM2G133048_P01 | 5 | 78904639-78918850 | + | 22 | 197 | 372 |
| GRMZM2G018686_P01 | 5 | 79055654-79056960 | − | 23 | 198 | 373 |
| AC212103.3_FGP002 | 5 | 79162381-79163631 | + | 24 | 199 | 374 |
| AC193606.2_FGP001 | 5 | 79175814-79176557 | − | 25 | 200 | 375 |
| GRMZM2G332749_P01 | 5 | 79183135-79188028 | + | 26 | 201 | 376 |
| GRMZM2G068176_P01 | 5 | 79200056-79201760 | − | 27 | 202 | 377 |
| GRMZM2G369391_P01 | 5 | 79229010-79230318 | + | 28 | 203 | 378 |
| GRMZM2G369396_P01 | 5 | 79229019-79230005 | − | 29 | 204 | 379 |
| GRMZM2G314233_P01 | 5 | 79503885-79505592 | + | 30 | 205 | 380 |
| GRMZM5G816609_P01 | 5 | 79505757-79510072 | + | 31 | 206 | 381 |
| GRMZM2G063942_P06 | 5 | 79531009-79538012 | + | 32 | 207 | 382 |
| GRMZM2G063942_P03 | 5 | 79531009-79538048 | + | 33 | 208 | 383 |
| GRMZM2G063942_P02 | 5 | 79531009-79538048 | + | 34 | 209 | 384 |
| GRMZM2G063942_P01 | 5 | 79531009-79538048 | + | 35 | 210 | 385 |
| GRMZM2G063942_P08 | 5 | 79531040-79538012 | + | 36 | 211 | 386 |
| GRMZM2G063942_P07 | 5 | 79531040-79538012 | + | 37 | 212 | 387 |
| GRMZM2G063942_P04 | 5 | 79531040-79538048 | + | 38 | 213 | 388 |
| GRMZM2G063942_P05 | 5 | 79537564-79538048 | + | 39 | 214 | 389 |
| GRMZM5G853950_P01 | 5 | 79666742-79669824 | + | 40 | 215 | 390 |
| GRMZM2G472708_P01 | 5 | 79679654-79682242 | − | 41 | 216 | 391 |
| GRMZM2G033138_P04 | 5 | 79697555-79699261 | + | 42 | 217 | 392 |
| GRMZM2G033138_P03 | 5 | 79697555-79710673 | + | 43 | 218 | 393 |
| GRMZM2G033138_P01 | 5 | 79697555-79710673 | + | 44 | 219 | 394 |
| GRMZM2G033138_P02 | 5 | 79697555-79710673 | + | 45 | 220 | 395 |
| GRMZM2G062885_P01 | 5 | 79857859-79861902 | + | 46 | 221 | 396 |
| GRMZM2G062914_P03 | 5 | 79862405-79867710 | − | 47 | 222 | 397 |
| GRMZM2G062914_P02 | 5 | 79862405-79867868 | − | 48 | 223 | 398 |
| GRMZM2G062914_P01 | 5 | 79862405-79867873 | − | 49 | 224 | 399 |
| GRMZM5G865405_P01 | 5 | 79960831-79961961 | − | 50 | 225 | 400 |
| GRMZM2G353478_P01 | 5 | 80084956-80086268 | − | 51 | 226 | 401 |
| GRMZM2G067313_P01 | 5 | 80187987-80190673 | + | 52 | 227 | 402 |
| GRMZM2G067313_P02 | 5 | 80188978-80190777 | + | 53 | 228 | 403 |
| GRMZM2G367431_P01 | 5 | 80191781-80192546 | + | 54 | 229 | 404 |
| GRMZM2G067350_P01 | 5 | 80195077-80199923 | − | 55 | 230 | 405 |

TABLE 3-continued

Examples of proteins of interest encoded by maize chromosome 5.

| Protein Identifier | Chr. | Positions | Strand | SEQ ID NO: | SEQ ID NO: | SEQ ID NO: |
|---|---|---|---|---|---|---|
| GRMZM2G067350_P02 | 5 | 80195714-80199923 | − | 56 | 231 | 406 |
| GRMZM2G031850_P01 | 5 | 80236478-80241911 | − | 57 | 232 | 407 |
| GRMZM2G031850_P02 | 5 | 80238986-80241911 | − | 58 | 233 | 408 |
| GRMZM2G031850_P03 | 5 | 80239243-80241911 | − | 59 | 234 | 409 |
| GRMZM2G024612_P01 | 5 | 80273499-80282785 | − | 60 | 235 | 410 |
| GRMZM5G852229_P01 | 5 | 80344025-80345337 | + | 61 | 236 | 411 |
| GRMZM5G829894_P01 | 5 | 80387639-80389787 | + | 62 | 237 | 412 |
| GRMZM5G829894_P02 | 5 | 80387639-80389787 | + | 63 | 238 | 413 |
| GRMZM5G829894_P03 | 5 | 80388596-80389787 | + | 64 | 239 | 414 |
| AC233959.1_FGP003 | 5 | 80411337-80411639 | − | 65 | 240 | 415 |
| GRMZM2G701675_P01 | 5 | 80446281-80446855 | + | 66 | 241 | 416 |
| AC233959.1_FGP006 | 5 | 80491807-80492790 | − | 67 | 242 | 417 |
| GRMZM2G392320_P02 | 5 | 80669160-80670554 | + | 68 | 243 | 418 |
| GRMZM2G392320_P01 | 5 | 80669160-80674679 | + | 69 | 244 | 419 |
| GRMZM2G147800_P01 | 5 | 80715081-80720509 | + | 70 | 245 | 420 |
| GRMZM2G093490_P01 | 5 | 80795990-80800856 | − | 71 | 246 | 421 |
| GRMZM2G482256_P01 | 5 | 80803727-80807409 | − | 72 | 247 | 422 |
| GRMZM2G425774_P01 | 5 | 80828457-80835734 | − | 73 | 248 | 423 |
| GRMZM2G425774_P02 | 5 | 80828945-80835734 | − | 74 | 249 | 424 |
| GRMZM2G165945_P02 | 5 | 80969412-80972258 | + | 75 | 250 | 425 |
| GRMZM2G165945_P01 | 5 | 80969412-80974450 | + | 76 | 251 | 426 |
| GRMZM2G165945_P03 | 5 | 80970381-80974450 | + | 77 | 252 | 427 |
| GRMZM2G400197_P01 | 5 | 81031951-81047638 | + | 78 | 253 | 428 |
| GRMZM2G104425_P01 | 5 | 81076870-81082921 | − | 79 | 254 | 429 |
| GRMZM5G887054_P01 | 5 | 81155197-81157909 | − | 80 | 255 | 430 |
| GRMZM5G887054_P02 | 5 | 81155255-81157909 | − | 81 | 256 | 431 |
| GRMZM5G887054_P03 | 5 | 81155675-81157909 | − | 82 | 257 | 432 |
| GRMZM5G887054_P04 | 5 | 81156713-81157909 | − | 83 | 258 | 433 |
| GRMZM2G088880_P01 | 5 | 81265211-81267499 | + | 84 | 259 | 434 |
| GRMZM2G088880_P02 | 5 | 81265211-81267499 | + | 85 | 260 | 435 |
| GRMZM2G088880_P03 | 5 | 81265354-81267485 | + | 86 | 261 | 436 |
| AC207104.3_FGP001 | 5 | 81273796-81274512 | + | 87 | 262 | 437 |
| GRMZM2G322672_P01 | 5 | 81761119-81763618 | + | 88 | 263 | 438 |
| GRMZM2G011888_P01 | 5 | 81793777-81797217 | + | 89 | 264 | 439 |
| GRMZM2G085513_P01 | 5 | 81798893-81800186 | − | 90 | 265 | 440 |
| GRMZM2G085469_P01 | 5 | 81801973-81806213 | − | 91 | 266 | 441 |
| GRMZM5G817948_P01 | 5 | 81858527-81859374 | + | 92 | 267 | 442 |
| GRMZM5G897067_P01 | 5 | 81859618-81861368 | + | 93 | 268 | 443 |
| AC199577.4_FGP004 | 5 | 81863099-81863686 | − | 94 | 269 | 444 |
| GRMZM5G823733_P01 | 5 | 81914498-81916850 | + | 95 | 270 | 445 |
| GRMZM5G812923_P02 | 5 | 81950191-81954891 | − | 96 | 271 | 446 |
| GRMZM5G812923_P03 | 5 | 81950191-81954891 | − | 97 | 272 | 447 |
| GRMZM5G812923_P01 | 5 | 81951639-81954891 | − | 98 | 273 | 448 |
| GRMZM2G464846_P01 | 5 | 81984901-81985250 | + | 99 | 274 | 449 |
| GRMZM2G024882_P01 | 5 | 82083639-82101253 | − | 100 | 275 | 450 |
| GRMZM5G868120_P02 | 5 | 82137780-82143124 | − | 101 | 276 | 451 |
| GRMZM5G868120_P01 | 5 | 82139338-82143124 | − | 102 | 277 | 452 |
| GRMZM5G867030_P01 | 5 | 82234311-82236318 | + | 103 | 278 | 453 |
| GRMZM2G409658_P01 | 5 | 82423451-82427210 | − | 104 | 279 | 454 |
| GRMZM2G111201_P01 | 5 | 82427780-82431853 | + | 105 | 280 | 455 |
| GRMZM2G409726_P01 | 5 | 82443403-82446794 | − | 106 | 281 | 456 |
| GRMZM2G409726_P02 | 5 | 82443815-82446714 | − | 107 | 282 | 457 |
| GRMZM2G409726_P03 | 5 | 82443856-82446714 | − | 108 | 283 | 458 |
| GRMZM2G005562_P01 | 5 | 82549227-82555670 | − | 109 | 284 | 459 |
| GRMZM2G005562_P04 | 5 | 82549246-82552090 | − | 110 | 285 | 460 |
| GRMZM2G005562_P03 | 5 | 82549246-82555641 | − | 111 | 286 | 461 |
| GRMZM2G005562_P02 | 5 | 82549246-82555641 | − | 112 | 287 | 462 |
| GRMZM2G005562_P05 | 5 | 82549299-82551111 | − | 113 | 288 | 463 |
| GRMZM2G005562_P06 | 5 | 82554608-82555670 | − | 114 | 289 | 464 |
| GRMZM2G005562_P07 | 5 | 82554971-82555670 | − | 115 | 290 | 465 |
| GRMZM2G006144_P01 | 5 | 82556313-82561535 | − | 116 | 291 | 466 |
| GRMZM2G006144_P02 | 5 | 82556337-82559047 | − | 117 | 292 | 467 |
| GRMZM2G443332_P01 | 5 | 82609175-82610100 | − | 118 | 293 | 468 |
| GRMZM2G167578_P01 | 5 | 82675654-82676901 | − | 119 | 294 | 469 |
| GRMZM5G844909_P01 | 5 | 82675825-82676822 | + | 120 | 295 | 470 |
| GRMZM2G390350_P01 | 5 | 82882273-82883691 | − | 121 | 296 | 471 |
| GRMZM2G158520_P01 | 5 | 82953053-82954942 | + | 122 | 297 | 472 |
| GRMZM2G459142_P01 | 5 | 82971168-82971688 | + | 123 | 298 | 473 |
| GRMZM5G844046_P01 | 5 | 83023500-83023965 | − | 124 | 299 | 474 |
| GRMZM2G564932_P01 | 5 | 83093332-83094205 | + | 125 | 300 | 475 |

TABLE 3-continued

Examples of proteins of interest encoded by maize chromosome 5.

| Protein Identifier | Chr. | Positions | Strand | SEQ ID NO: | SEQ ID NO: | SEQ ID NO: |
|---|---|---|---|---|---|---|
| AC197265.3_FGP005 | 5 | 83145879-83146355 | + | 126 | 301 | 476 |
| GRMZM2G087267_P01 | 5 | 83277783-83281412 | + | 127 | 302 | 477 |
| GRMZM2G087267_P02 | 5 | 83277785-83281412 | + | 128 | 303 | 478 |
| GRMZM2G087267_P03 | 5 | 83279034-83280630 | + | 129 | 304 | 479 |
| GRMZM2G032280_P01 | 5 | 83397014-83400242 | + | 130 | 305 | 480 |
| GRMZM2G087495_P01 | 5 | 83402967-83405797 | − | 131 | 306 | 481 |
| GRMZM2G387127_P01 | 5 | 83435480-83437132 | − | 132 | 307 | 482 |
| GRMZM5G889792_P01 | 5 | 83521923-83522252 | − | 133 | 308 | 483 |
| AC234515.1_FGP003 | 5 | 83557023-83560095 | + | 134 | 309 | 484 |
| AC234515.1_FGP002 | 5 | 83567769-83572400 | + | 135 | 310 | 485 |
| GRMZM5G894416_P01 | 5 | 83606990-83607661 | + | 136 | 311 | 486 |
| GRMZM2G050080_P01 | 5 | 83743980-83745342 | − | 137 | 312 | 487 |
| GRMZM2G088396_P01 | 5 | 83859479-83861633 | + | 138 | 313 | 488 |
| GRMZM2G088235_P03 | 5 | 83860797-83865914 | − | 139 | 314 | 489 |
| GRMZM2G088235_P02 | 5 | 83860797-83865920 | − | 140 | 315 | 490 |
| GRMZM2G088235_P01 | 5 | 83860797-83865920 | − | 141 | 316 | 491 |
| GRMZM2G088235_P04 | 5 | 83861394-83865914 | − | 142 | 317 | 492 |
| GRMZM2G088235_P05 | 5 | 83864692-83865653 | − | 143 | 318 | 493 |
| GRMZM2G387123_P01 | 5 | 83867332-83868010 | − | 144 | 319 | 494 |
| GRMZM2G449843_P01 | 5 | 84018779-84019752 | + | 145 | 320 | 495 |
| GRMZM2G322129_P01 | 5 | 84061561-84065912 | + | 146 | 321 | 496 |
| GRMZM2G017741_P01 | 5 | 84083388-84086632 | + | 147 | 322 | 497 |
| GRMZM2G017802_P01 | 5 | 84088707-84089603 | − | 148 | 323 | 498 |
| GRMZM2G074634_P05 | 5 | 84101452-84104814 | − | 149 | 324 | 499 |
| GRMZM2G074634_P01 | 5 | 84101452-84105175 | − | 150 | 325 | 500 |
| GRMZM2G074634_P02 | 5 | 84101452-84105175 | − | 151 | 326 | 501 |
| GRMZM2G074634_P04 | 5 | 84101452-84105175 | − | 152 | 327 | 502 |
| GRMZM2G074634_P03 | 5 | 84101452-84105175 | − | 153 | 328 | 503 |
| GRMZM2G074634_P06 | 5 | 84103364-84105175 | − | 154 | 329 | 504 |
| GRMZM2G026117_P02 | 5 | 84248220-84251635 | + | 155 | 330 | 505 |
| GRMZM2G026117_P01 | 5 | 84248220-84252180 | + | 156 | 331 | 506 |
| GRMZM2G026117_P03 | 5 | 84248224-84252180 | + | 157 | 332 | 507 |
| GRMZM2G005998_P02 | 5 | 84252053-84253030 | − | 158 | 333 | 508 |
| GRMZM2G005998_P03 | 5 | 84252053-84254208 | − | 159 | 334 | 509 |
| GRMZM2G005998_P01 | 5 | 84253581-84254208 | − | 160 | 335 | 510 |
| GRMZM2G107026_P01 | 5 | 84314151-84314930 | − | 161 | 336 | 511 |
| AC211514.2_FGP003 | 5 | 84338664-84340523 | − | 162 | 337 | 512 |
| AC208217.3_FGP001 | 5 | 84516113-84516340 | − | 163 | 338 | 513 |
| GRMZM2G127999_P01 | 5 | 84706267-84706916 | + | 164 | 339 | 514 |
| GRMZM2G128012_P01 | 5 | 84796405-84799488 | − | 165 | 340 | 515 |
| GRMZM2G427468_P01 | 5 | 84799805-84801081 | − | 166 | 341 | 516 |
| GRMZM2G382914_P05 | 5 | 84821810-84824816 | + | 167 | 342 | 517 |
| GRMZM2G382914_P04 | 5 | 84821810-84825422 | + | 168 | 343 | 518 |
| GRMZM2G382914_P02 | 5 | 84822183-84825763 | + | 169 | 344 | 519 |
| GRMZM2G382914_P03 | 5 | 84822215-84825763 | + | 170 | 345 | 520 |
| GRMZM2G382914_P01 | 5 | 84822215-84825942 | + | 171 | 346 | 521 |
| GRMZM2G007372_P01 | 5 | 84840183-84843411 | + | 172 | 347 | 522 |
| GRMZM2G010321_P02 | 5 | 84934242-84936441 | + | 173 | 348 | 523 |
| GRMZM2G010321_P01 | 5 | 84934242-84936493 | + | 174 | 349 | 524 |
| GRMZM2G010754_P01 | 5 | 84938287-84943705 | − | 175 | 350 | 525 |

The above examples clearly illustrate the advantages of the invention. Although the present invention has been described with reference to specific details of certain embodiments thereof, it is not intended that such details should be regarded as limitations upon the scope of the claimed invention except as and to the extent that they are included in the accompanying claims.

SEQUENCE LISTING (613 sequences)

SEQ ID NO: 1 - DNA, 621 bp, Zea Mays
atgcggaggggatccgaggctgctgttttggaccggcatcgctgcgcacagaacttggatgccatggctgccggcagaacaggggttccttgctgtcgcactaggggaaaaggaggtaggaggcgagcagcagcagtggaggggatggtgctgtccttggctgggagagcttgcgcgcactgccctgatgccggtctggaacagagaggaaaagaggagggcgtcgttggggagaggaggaagacaacttggggaagattgcagggggggcgcttggtagagagagaggagcaggggcgagctcaaggcgctcctggcttgggcgtccatggcggcaggaggatgaagacaacgggaaaaaactgctcgcagggggaaacgccgactggaaaaatggaggctagggcgagctcggctgcttcggtgcgaggaagaaagagcaggggcgccatggacgacggcgaggaggatgtcgccggggaatgggagctgctgctccacgccatggacatggagttcggcggccctggaaaaaatggagcccacgcctgggctggtgagcgtctgctccaagggagctcggccatggagcagaaggggcgctgctgccctgcgcgctag

SEQ ID NO: 2 - DNA, 1755 bp, Zea Mays
ccttcaccaaacagatgctcagggtctttaacttcgtggaactcgaagagctgggtcatttggtcgccgaagcttgatcgtcgattcctcgaagttcggagttggatcgcagtctattcgcgacgcacagcgaatacaaacaggaacaaacaaacaaccatatatatgcataggaacattacatcattcaagtaaagcatagtaaaatacgcaaaataaaatagagtgtgctactatggtcacacgaggacaaagaaacgcgatagttggagctatggtcgagaagtcaacgggtttacgctaagcaagtattaaatggaatatttaatccgatatctctatattaattgatattaattaaatgtaaactaacactgctacttagttctagtctaacttacccttttaatagttgatgatcaaataagtaactaattaattcacatgagtaattataaacaaatggtttaatctcgcacgcggcgaggcgtgtgacacacgcgaacgacgcgcgacaacgcgggcgaacaacacgcgcggacgacacgcgacgacgcgcgcgacacacgcgaatgactaactaatttcgtgtttatactaagcaagaataaattaaaaacatttgaattggcataatcacattaacatgtattaataaaaggggagcttaaaacgataagttatttttaactaacagttatttttaataaccaacgaacgaactaacaattaactaaataaataaaacatggatcttgacaaaacaatatttttaacgtgtgcacgacattattacgaagctaacgcaatctgaacaatataaaatggatttataacataaactctaacatgtatttaataaactgcaaatttaaagtgatatggtgcgttgtgattggtccgagccaaatcccagggatggtcatggattttgcatccacctcggatccttggaggactgtttcccttgatctcatgcaggcaggagaggaatacgacatgcaacgtggggctcacggtcatttctacttgcatgcctttttcccatgcatgacgtgtacggttgatttttctctccctaccaccacggggcattcaagcgagttagttgctggccaggagatggaccacgtcggtgtcggcggccatggccaggcgacggtgatgcggccagtggagcagggtagcggcccccgacagttcttccatggacgagctgcaaggggaaggagcccaccggtcggagcgggcgtggccgctcgccggccagggcgtgcagtggccatggtgggtcggtggtgctcatggcacggcagcgtggcatcgcggcaatagagaaggagaggggaaatagcatagcatggccttaccttggcaacgcgagatgtagcgaccacacatgccaacaagatcgtcggagcagtgggcgtatggcggaagtgacgtgtgcgcagggcatgacgacggccatggctacgcggctgcggcggcgtccgggcacagcaacacgtaggggatgggcgagggctctaatcgcacgcctccatggggcttttgcggagggtgctgggagctcggccagaggacatgcacgtggggcttctctgcaggacgacgagcgcagagagggcgaggcgagcgcgagatgcagcaaggtgaggcgagatgccgcgaggcgaggatgtggtgcggcggctgcgcgcaagacgtgagggagtggcggtttgaggaagatgaacagtgtgcagcggcggc

SEQ ID NO: 3 - DNA, 1782 bp, Zea Mays
gccgccgctgcacactgttcatcttcctcaaaccgccactccctcacgtcttgcgcgcagccgccgcaccacatcctcgcctcgcggcatctcgcctcaccttgctgcatctcgcgctcgcctcgccctctctgcgctcgtcgtcctgcagagaagccccacgtgcatgtcctctggccgagctcccagcaccctccgcaaaagccccatggaggcgtgcgattagagccctcgcccatcccctacgtgttgctgtgcccggacgccgccgcagccgcgtagccatggccgtcgtcatgccctgcgcacacgtcacttccgccatacgcccactgctccgacgatcttgttggcatgtgtggtcgctacatctcgcgttgccaaggtaaggccatgctatgctatttcccctctccttctctattgccgcgatgccacgctgccgtgccatgagcaccaccgacccaccatggccactgcacgccctggccggcgagcggccacgcccgctccgaccggtgggctccttccccttgcagctcgtccatggaagaactgtcgggggccgctaccctgctccactggccgcatcaccgtcgcctggccatggccgccgacaccgacgtggtccatctcctggccagcaactaactcgcttgaatgccccgtggtggtagggagagaaaaatcaaccgtacacgtcatgcatgggaaaaaggcatgcaagtagaaatgaccgtgagccccacgttgcatgtcgtattcctctcctgcctgcatgagatcaagggaaacagtcctccaaggatccgaggtggatgcaaaatccatgaccatccctgggatttggctcggaccaatcacaacgcaccatatcactttaaatttgcagtttattaaatacatgttagagtttatgttataaatccattttatattgttcagattgcgttagcttcgtaataatgtcgtgcacacgttaaaaatattgttttgtcaagatccatgttttatttatttagttaattgttagttcgttcgttggttattaaaaataactgttagttaaaaataacttatcgttttaagctccccttttattaatacatgttaatgtgattatgccaattcaaatgtttttaatttattcttgcttagtataaacacgaaattagttagtcattcgcgtgtgtcgcgcgcgtcgtcgcgtgtcgtccgcgcgtgttgttcgcccgcgttgtcgcgcgtcgttcgcgtgtgtcacacgcctcgccgcgtgcgagattaaaccatttgtttataattactcatgtgaattaattagttacttatttgatcatcaactattaaaagggtaagttagactagaactaagtagcagtgttagtttacatttaattaatatcaattaatatagagatatcggattaaatattccatttaatacttgcttagcgtaaacccgttgacttctcgaccatagctccaactatcgcgtttctttgtcctcgtgtgaccatagtagcacactctattttattttgcgtattttactatgctttacttgaatgatgtaatgttcctatgcatatatatggttgtttgtttgttcctgtttgtattcgctgtgcgtcgcgaatagactgcgatccaactccgaacttcgaggaatcgacgatcaagcttcggcgaccaaatgacccagctcttcgagttccacgaagttaaagaccctgagcatctgtttggtgaagattaccttttgggctactatggttagat

SEQ ID NO: 4 - DNA, 2794 bp, Zea Mays
gcactagtcgctactagctagatagccatatcaccagcatgtggaggctgacggtggccgagggcggcggcccgtggctgcgctcgacgaacggcttcgtggggcgggcggtgtgggagttcgaccctgacctcggtacgccggaggagcgcgacgaggtagagagggtacgccaggagttctccgaccaccgcttccagaggagagagtcggccgacctcctcatgcgcatgcagtgcgcaaagcagaacagatctcaacgtcgtgatctgccacgcatcaagcttggggaggatgagcacgtcactgaagaaattgtactgagctccttgaggtcggctctggaccagttctcttcactgcaagccagcgatgggcactggcctggtgatttcagcgggattatgttcatcatgcctggtttgatatttgccttgtatgtcactggatcactgaatgttgtcatatcaccagaacatcggcatgagatttgccgctacatctacaaccaccagaacgaagatggtggatggggcacacttatcctgggttcgagcaccatgtttggcacatgctcaaactacatcaccttgaggcttctcggtgaggagccatacgccaacaacagtgtgttggctaaagggcgtgcttggattctatcccatggtggtgcaaccttgattcctcagtggggaaaaatatggctttcggtacttggattgtttgattggtcaggaaataatccaattttccctgaactatggtccattccccagtttcttccatttcatccagggaaattctggtgctttgcccgtatggtatatctaccaatggcttatctttatggcaagaaatttgttggaccaattacaccaactatattggcactaagagaggaaatctatgacactccttatggaaagattgactggagtgatgctcgtagtaaatgcgcaaaggaggacctcatctgtccacgcacactgttgcagaatgttatttggacttcactttataggtgtgtggaaccagtattgagcagttggcctatcaacaagctgagagagagagctctgggaaacatcatggagcatatccattatgaagatgagaacacacaatacctatgcatatgtcctgtgaataaggctctaaacatggtctgctgctgggtagaagatccaaattcagatgcattcaagcgtcaccttgcaaggataccagacttcttgtggatttcagaagatggcatgaaggcacaggtatatgatggctgccagagctgggagacatcattcataattcaagcattttgcgctacagatcttgttaatgactatggttcaactcttcagagagcctatgagtttatgaaaaattcacaggtcatgaggaaccatcctggtgaccaacgttattggcatcgccatagatcgaagggttcatggacactttcatctgcagacaatggatgggctgtatctgacactacaggagaagcacttaaggctgtactgttgctgtcaaagatctcaaacaaaaacaaccttgttggggatccaatagaaagagaaaggttgcatgacgctattgattgccttctatcttttgcgaacaaagatggcaccttttctacatatgagtgcaaaagaacttattcttggttagagattctaagtccttgtgagactttcccaaacattgttgtcgattacccttacccagaatgcacttcatcagtgctccaagctctgatattgttcaaagacttatatcctggttaccgcacagaagagatagaagcattagttagaagtgcagcaacgtttattgagaccaaacaacaagaagacggttcatggttaggtaattggggtatatgtttcacctacggggccttcttttcgattaaaggtttagtcgcttctggaagaacgtacaagaacagcccttgcatacggaaagcatgccacttcatattgtcgaagcagctcagtactggtggatggggagaaagtcatatcgctattgaaactcaggtgtatgtaaatctcaaaggtgaccgtgctcacgctgtgaataccgcctgggcaatgctcgctttaatttatgctggacagtttgaacgagatccaacgccattacatcgtgctgcaaaggaattgatcaacatgcaactggagacaggagagtttcctcagcaagagcatgtaggatgcttcaactgcagcctctacttcaattacccaagctaccgcaacttgttccccatctgggctctcggtgagtaccatcgtggccttcgtgcaaagaaagacaattgagtccgtgtgtgtatatatatagtacgtatagcattgtgaggaataaaacaggttgcgtcggtggtgagtgcgcaaaaacaagatgtgcttttatgtaggtgtaccacagtgtacaatgttggtcgttgttagactgtaaggctatcatgacgtgtatattgtaatatatatactacgtgattggtgtcctgtatggtcacggccatactcgctgcgtgcgtagagcgcatgattggcttcctgcgcgcgtagaagctaggctgccacgcgccggtgcgatgtaggatattttttcattcatttgctgcatccatggagaagccagggagggacgtttcccacgggccaggatggcgcgcgcctggcgacggtgagcgcgcgaaccaatcacacgttatagtgttccatatgtttcaaattatataagacgttttatcttctctaatgaacgagcagtctcctttccc

SEQ ID NO: 5 - DNA, 719 bp, Zea Mays
acggcagcctgtcgctgtcaccgtcgtcatcttcctcctgtgatcgccccgctccgcttctgcaggccacggctgggcgacaccctgatggcgtcgcctcctcccgtggcgaccgcggggcctcacagcgtcttcgtgtacggcacgctgatggaagaggaggtggtgcgtgtgctcctgggccgcgccccgccctcctcctcccccgcgctcctccccgaccaccgcaggttcagcctcaggggccgcgtctacccggccatcctccccgcccgcgcccacgcggtgagcggaaaggttatccaggggctcaccgacagggaactccatgtgttcgacatgttcgaggacgaggagtatgtgaagacaaccgtcgaggtctcactgactgatgcatcggagaaatcactcgcctacgcctacatatggggtaaccagggtgatcctgacctctacggggaatgggattttgaggagtggaggaaggtgcatttgaagtactaccttgagatgactcgggaattcatgctggaactcgggcaattttaaacacttctctggtttgtaactacacaggagtcagaggatccttgcaaaactaccatagaataatttgtgtcttgtgctcgacgagttcttgctactatgctgctttgggaacatacacatgttatttgagccatttagtcatttggatgtgaacaaatcgattcttctct

SEQ ID NO: 6 - DNA, 4127 bp, Zea Mays
acggcccttggtcttcgtgagctgctgctcgcgttgtcggggaggcgccgccacgccgctcgcctcgcctagcgccgcgtccggattccggagcaacaactcctaggcaggtagtagtagtagcctagtaggttgtgaacgacccggccggccggcggcgcggtgcagcgtccccgctgctccatgcccgagggccaccagtgaagctcccgcgtggccacgcgacgcgaccatgaagcagtccccggccagctctggtgtcacggccgcgcccgtcgtccctgcccccgcgcccgcggccgcctccaccggcgcggcgccgccatgcgaaggggagcggaaggcgccggcgatcaacgccgacctgtggtacgcctgcgcgggcccgctcgtgtctctgccgccggtgggcagcctcgtcgtctacttcccgcagggccacagcgagcaggttgcagcttctatgcaaaaggacatcgatgcacatgtgccaagctacccaaatcttccctcaaagctgatatgtcttcttcacagtgttactttgcacgctgacccggatactgacgaggtgtacgcgcagatgactcttcagccagtgaacacgtatgggaaagaggctttacagctatcggagcttgcactgaaacatgcaaggccacagatggagttcttctgcaagacgcttactgcaagtgatacgagtacacatggaggcttctctgtgcctcgtcgtgctgcggagaagatattacctccactggacttcggtatgcagcctccggctcaagaacttcaagccagggacatacatgacaatgtgtggacatttcgccatatatttcgaggtcagccgaaaagacacttactaaccactgggtggagtctttttgtgggcggcaagagactatttgctggtgattctgtcatttttgttagggacgaaaggcagcaacttctactgggaatcagacgggctagccggcaacccactaatatatcttcttcagtactttcaagtgacagtatgcacataggggtgcttgctgcagcagcccatgctgctgccaacaatagcccatttaccatattttacaatcctagggctagccctactgagtttgttatcccatttgccaaattccagaaggcactgtatagtaaccaaatatctttaggaatgcgattccggatgatgtttgagaccgaggaattagggatgagaaggtacatgggtacaataactgggataactgatctagatcctgtaagatggaaaaactcccagtggcgcaacttacaggttggttgggatgaatctgccgcaggggaaaggagaaacagagtttcaatgtgggagattgaaccaattgctgctcctttcttcatatgcccccagcctttctttggcgtaaagcgccctaggcaaatagatgacgagtcatcagagatggaaaaccttttcaagagggcaatgccttggcttggtgaggagatatgcataaaggacgctcagacccataacaccacaatgcctggtttgagcttggttcaatggatgaacatgaacaggccgcagagctccacattaaatacaggcatacagtcagagtatctgcgatctctaagtaaccctgccatgcaaaaccttggtgcggctgagctcgcaaggcagctatatgtccagaaccatctcctgcaacaaaacagtgtacagcttaatgcttccaagctccctcagcaagtgcaacctataaatgagcttgctaagggatcattgtcttgtaatcaacttgacgtcatcatcaatcaacaagaactgaagcaagaagttggcaatcagcagaggcaacagcagcccgttaaccaagcaattcctttaagtcaggctcaaaccaatcttgtccaggcccaggtaattatccagaatcagatgcaacagcagcagcaacaacagcagcagtctccaactaggtgccagaagggaaccagtgtgcaacagctgcttctttcacagcaacagcaggaccagaattttcagctgcagcaacaacagcagcttttacttcagcaactgcagcagcagaatcagcagcagcagcaacaacagcagaatcagcagcagctaaacaagttgccagctcaacttgtgaatctggctggtcaacaggctcagttgtctgaccaggaacttcagctgcagctattacagaaactacagcagcagtcacttgtatcacagccaacagttacactctcgccgttacaggtaatacaggaacaacagaagttacttttggacatgcagcagctatcaagctctcattcacttgcccagcagcggatcctgcctcaacaagatagcgatgtttcgctgcaagcatcacaggcgccaccaccaatgaagcaagaacagcagaagccttcacagaaacaatttgtgcttgcagatgtgtcagatgttgtctatccacagatttcatcaaccaacgttttgtccaaagctggaacccaactgatgactccaggtgctacacaatctgtactaacggaggaaattccttcttgctcaacatcaccttctacagccaccggaaatcatttggcatacccaatcattggcaggaacgagcattgcaaggtcaccattgagaaagttcctcaatcgtcttctctgatgtcaattccaacagctggtgaagctgtaacaactccaataatggcgaaggaattgtcaaagttgaaccataatctgaaggagaatgtaaccacatcaaagtcacccattgttgggactggacatgagaatcttttgaacattgtaccgtcaacagacaacctggaaacagcttcatcagcaacttctttatggcctacccaaacagatggacttttgcatcaaggttttcctactaacttcaatcaacaacaaatgttcaaagatgcacttccagatgtggaaattcaagaagtggatccgactaacaatgccttctttgggatcaacagtgatggtccattgggctttcctatggaaaccgaaggcttgttggtaagtgcaattaatcctgtgaagtgtcagcctaatttgtcaactgacgttgagatcaattaccgaatacaaaaggatgcccaacaagagatctcaacctccatggtttcacagtcattcggtcagtctgatatagcttttaactcaattgattctgcaatcaacgatggtgtcatgttgaatagaaattcttgcccccctgcacctccgcagagaatgcggacattcacaaaggtctacaagcgtggagctgtaggccgatccattgacataggcaggttctccggatatgaagaattgaagcatgctgtggcccgcatgtttggtatagagggccaacttgaggaccgacagagaataggatggaagttagtctacacggatcatgaggatgacgtcctacttcttggtgacgacccatgggaggagtttgtgaattgtgtgaagtgcattaggatcctatccccccaagaagtgcagcagatgagcttagatggtgatttggggaacaatgtcctctccaaccaggcttgcagcagctcagatggtgggaatgcctggaagcctcgccgcgaccagaaccctggtaacccttccatcgggttctacgaccaatttgagtgacctgatcacggaaattcgagatgagaattatagctgcaaaaagcaaccagtgtccagccatctacagaattatcgccacggaaagggtaagcagatgcaggatgccgtagacgtcttggcttttatagttgggagaggaaatgctcctcagattagggtatgttctagatatatgtgtagttttctttgttttgaaacaatgtaggcaagaagaatgaaacttacctagagctgttgctgagtcgaaacatcagacagatggttaggcaaaacctgaacttcagacagagtaggcagatctgaagataaagtattttgattgagagtattttgtaattctgtattgaactgccgctggggtttgcttgagacccatgcggcactatatgagtctctctcagttcagaaaatactgaagcagatctaagaggtcctactgattattactata

SEQ ID NO: 7 - DNA, 791 bp, Zea Mays
gtccgcctgggaattaatctcagatcgggcaccgccaggcaatttggctctcttcttgatggatgattggtggagccatggcacttggatcgtctcccagccgtgaactcgtgtccgaagcccaagtttggtgcgcaatgtccgccttcttcctctgtaacaaacgtcatatctctcgtaactgaattcagttggcacgatcccgggtggatcctggtaatggccgtggattcctggggatataaatagcaggcgtgcccttcctcttgaccataatccggttagaagctagccaaggcacgaacaaagcaaagctgggcgttgcaccgacgagctgggtgtgtctccagtttgccggctattgctcgccgggctcttgacggggtgccgtggtgcgtgccatcggggcaggcgttgccagatctgggatggtcaccgtggtcgcgattccatcaaaaaccgcagggcatgtgggagatcgccgccatggctgctccttatctgggcgcgggattgatgccagtaaagtactcatgaagggtctcggtcgcacgctacacgtggttgtggcctcctcagcgttgttgtccaccagagcgctatcaattggtcaccagccatggccgccaccacgggctgtgcaagcgccgccgcaactgaggctggtgggcagtggtgacatgatggccgttgattggcccacgtgtggacaggatggggggaccatccatcccttcgctcgggttaattctggccgctggatcggatgcagatggacgggattagatcag

SEQ ID NO: 8 - DNA, 1813 bp, Zea Mays
gcgtagccgacgacgccgacgacgaggcagccatggccgcccccgccgcccggagaatagttggcgctgaggttcccatacccggctcggacaagctgcggtggatcgacctcaccatcccctcgtcctccgccgctgcgccggcgagcccctccgatcccttcgtctgcgtgcccccgcgtgctgcctcggggtgccacatcatcccttcgggcgattctcagtattacctctcgtggaggattcacgaggaacacccaaatgtgctggaggtcattgaacttagtccctccaaggagttccctagctttggactgcgtcttgccttccaggaggcgctatctccattcgcctttctatgtgaacgagagggtcgcaggcaaggggagcttgtatatatgctatatgtgcttaccgtttctggagttgctcttttgtgccacctacgcagcccattttcctacgtatctggttcagtgctgcatcaggatgatatagctgagtttaatctccaaactcaagctcagagcgcaaaggttacagcggtaacagcgaagccaggatgtattgtgattggtcggcaagatgggtccatctgttcttacagtcttggcaaattagccccaaactcaccaggtttctcgaatgaactacgagatgatgctgggattggacgtttatggactctcatgtcaagaacaaagactgtgggtcctgtgcaggacatagtagcaactgttgtaaatgaaagggacctgttatttgttcttcatttggatggacacttgcgcatatgggataatcacatgaaacttctcaactataatgtccactcaaatgacattgaaggccatccgtccaggctatgggttggtaaggctgatgatgatcaggagttgatatctttggcgattctgcatcaaaacactgtggttcaaggttgtgattatgttgctgtatatggcttcggtttttctgctgcggaaaggttcatgttctcttctgaaccttcaatttctactatacctttgctagaggggaagcttgcggacttgaaaatagccacatataagctttggatacttaaagaatttggctccatgctctatgaaatattacagtatgacattgacaccgaaactgcaaaatgttgtagtgagaaggtttgctgttatgtgctacaagaagatgctatcagtgaacagttgtttcaaagttctgacaatgcattggatgatttggtttggacagctgattcaatgttctcctccttgaaggaacaggcttttactttgatttcatccatgtttctgcggaggctacttcaaccaggagtaaaccactgttctgccctacgtgaaaccttactagagcataaaaggttcctatcagattctgagttccagtcacttacagcaaatgggctacgaaaagagatattatctattatagaacaagagggaagttcacagacagcaagtgctacagcttatcactggaaacaattctctgcacggtacctccacaattggtgctggcacaataagccctatggattgtttcttgatactacaaatgaagtgtttggtttagtaagaaagggttcattttctctattccgttgtttggagggtctggagatgcttatttatggttatgaccatggggtgaacttactcgacgatgtgtctgattttgaactcctcaatgaggtcctcagatgcatgggcaatatacaccatttgctggggagatcttccacagcagcatattatgaatccttaattagttctattatatcatctgatgaaat

SEQ ID NO: 9 - DNA, 1840 bp, Zea Mays
atgctgtttgtgttatccagttgtttttctcatcattttatgcaagggatgctcactattagattggagcttaaatttgcctcttacctgtggaaataggttctttgtgacggagagattccattcactggcttggtagagaaagtggagcaagagctcttctggaaggctgagcgctcagatctgtcgtctagaccaaatctctataaggttctttattcatttgaagcacataggaacaaatggaggaaagcagctgcatacatgtacaggtactttgttagattgaatagagaaggtaatgcaggcggcagccaccaacttcctcacgtgttgcaagagaggttgcatgctttatctgctgctatcaacgcattgcagcttgttgatccctcatttgcatggctcgattctatttgtgaagccgatgataaaatttctccaagtaaaagaccccggaatcttttgatggagaactcggcttttggcacaaactcagaactttctagattgcaattttgtgttgacattgaaatccttgaaaaagaatacatattaacagaagcacagtatatgctcagcactttgaaatcaagttttgatttttcagaaagccaatctattgagtccctgatggatattcttataaatgagaaattgtatgatatagccttcacaattgtgctaaaattttggaaggagtcagaaataaaaaagcaattggaccgtgtattttcagtcattgcgcagcaatgctgctcgaacagatcagacaacaaatcaagtaaacaagtgccacttctgccttcttctgagaatgatgcatgggagatcaacaataggagtattgctgtgacccaacaattgcaggggagcaaccactgggaaacccttgaactatatttggataaatacaaagacctgcatcctaggttgccagtcattgttgctgagacgcttctttatactgatcctgagattgagctaccactttggttggttcagatgttcaaggctaataaggcagggaacaagatctcatggggcatgtctggaaaagaggcagatcctgctgctttattcagattgtacataaactacggacgccacgcagaagccaccaacctgctggtggagtatctagagtcgttcgcatcgtcgaggccagtggacgtcctccaccgcaagaagatgtccgccgtttggttcccctacaccgccgtcgagaggctctggtgccagcttggtgagatgcaacgggcagggcacagcgtggatcagtgcgaccggctcaagaagctgctgcacggagccctgatgagccacctgcagcaggtcgtggtcgactcggatgatgtgctgtcgtcagttggagatgggcaggggatggaggaccagagcagctgaagtcctgaagatcgtgttgttggcatgtgtagaaaacgatgtgccaccgctggatactgtatgtgattgtttgtgtggtcagctgaccaagagttacgcctgtgtcttttatatagaattattattagatgaaaacaaagacggagcgatggctccatttgtaacgtgagcatggaactgtcgctgatgacgagctgttcacttcccatgtgtagatgtagaaggtggattgacgcatccattacagcactgctgcactggtattgtatcggttctgccttcggggtgtgtaatggggttgttgcgatcgggttcagattagtgttgagcgtcgtggcattagggcatgtacaataccattcaatatatggtcttttaaggggtttctaaagagttaattaaaaaaatacaagagattacctctttatgaaaa

SEQ ID NO: 10 - DNA, 2693 bp, Zea Mays
ccaaatacgcgctctcgtgctcgtgcgcgcgcgtcgcctcccaccccttcgtccgccgttgccgcccgcactctcccttccgccgtcgtgggcgcgcggcgacggggagagaggcaggtgaggtcggaagcggcggcggaggcgggcccccctccgtctactcttactcacgcacaccacggcgcccgcgagctagcgccctagcggagcggaggtcgaggcgggagaaaggcggttggggctccccggtgggcaggggggggggggggggggtcggaggcggggatggggctcgacggcacggtctcgggggtggtgtcgaggaaggtgctgccggcgtgtggtgggctctgctgcctctgcccttcgctgcgtccccgctccaggcagcccgtcaagcgctacaagaagatcctcatcgacatctttcccgcggagcaggaagacggaccaaatgtgaggaggattgggaggctttgcgagtatgttgctagaaatcctcatcgcgtgccaaaggcgggctgtgcttctcacctcaagcgtcctacaaattgcatctaatctgttacttccacttcacttgttttctcatgcgtattggtgtctgtgcagatcacagcttacttggagaggaggtgttacagggagttgagaaatgagcagtatgacattgtgaaagttgttgtgctaatataccgcaggctattggtctcttgtaatgaacaaatgccgttactggcaaatagtttattaagcatcatacaaacacttttggatcaatcaaggcaggatgacatgtgcatcattggctgtgaaaccttgtttgatttcatagtcactcaggtggatggtacatatcagttcaatttggaagagtttattccaagactctgcaaactttctcaaatagtaagggacaaagagaaggctaatgcactccgtgcagcagctctgcaatcactctctgctatgatctggtttatgggtgagctctctcatatctcctcagagtttgatagcgttgtccaagtagtattggaaagctatgagcctcgacaggtgcaaagtgacaatagtgccactgaaaatccaggttgtcagttggttgaagaggtccttaaacccgagggtcatgcctctccatcgacatttatattttctgtgataccttcttgggacagcatagttagtgactatggaggaattcaactgcttatggatgatgccaaggatccttatttttggtcaagggtctgtgtgcataacatggccaagctgtccagggaagcaactacattccgccgtgttatggagtccctattttgccacttcgataatactaattcatggtcatccaaaaatggtcttgcactttgtgttctattggacatgcaaatgttcatggaaaagtcagggacaaacattaatttgatgatatcagtactagttaagcatctcgaacacaaggccatactgaaacaacctgagatgcaactcagcattgtcgaagtgataactgctcttgcagaacaatcaagagctcaggcttcagcagcaaccatagttgctataagtgaccttgtgaggcatatgaaaaagacactgcatttagctcttggcagcaacgatttggaggtggtaaagtggaatgacaaactccgcatggcttttgatgaatgcatagtccagctgtcaaagaaggtaggtgatgctggaccagttcttgacatgatgtctgtgatgctagagaacatatcacacactcctcttattgctatagcaactacttctgctgtttatcgcacagctcaaataattgcttcaataccaaatttgtcatataagaacaaggtatttccagaagcactttttcatcaattgctgttagcgatggttcaccctgatcatgaaacacgtgttggtgcacaccgcatattttctgttgtccttgtcccatcttctgtttctccttttcccaatttgaaatccctagatcagtgtagaaagcatgatgtccagaggacactctcgagggttgtatctgtcttctcatcttcagctgctttatttgataagctgagaagggacagaaactcctttagagaatatttacatgaaggaagcatgaacagaattttgcatggtattgatgatgaaattgctacccctaatgacttgccaggctcgcaaagcttgagacaaagcctcagactttcttcagtgtctcacaaacattcttatacttctttaaaggaaggtcaaagtcccttgacagagtcaatcaacgaaatggaaacaattgtgttaagactaagcagccagcaggccactcttctgctctcatctatttggcgtcaagcactttctccaaaaaatgctcctcaaaactacgaagctattgctcatacatatagtttgcttctattgtttttgggatcaaagacaccaatttttgaggttcttgctcccagctttcagattgcattttctttaatgagccattcacttggaggaacagattcattgccaccatctcgccgccggtcattatttactctggctacatctatgattgtttttgcctcaagagctttcaatgtggcacctcttctcccaatttgtaaattaatgctcaatgatggaacggtgcgtccaatcgtattcctctcaatcatctctttttttgttttgag

SEQ ID NO: 11 - DNA, 3258 bp, Zea Mays
ccaaatacgcgctctcgtgctcgtgcgcgcgcgtcgcctcccaccccttcgtccgccgttgccgcccgcactctcccttccgccgtcgtgggcgcgcggcgacggggagagaggcaggtgaggtcggaagcggcggcggaggcgggcccccctccgtctactcttactcacgcacaccacggcgcccgcgagctagcgccctagcggagcggaggtcgaggcgggagaaaggcggttggggctccccggtgggcaggggggggggggggggggtcggaggcggggatggggctcgacggcacggtctcgggggtggtgtcgaggaaggtgctgccggcgtgtggtgggctctgctgcctctgcccttcgctgcgtccccgctccaggcagcccgtcaagcgctacaagaagatcctcatcgacatctttcccgcggagcaggaagacggaccaaatgtgaggaggattgggaggctttgcgagtatgttgctagaaatcctcatcgcgtgccaaagatcacagcttacttggagaggaggtgttacagggagttgagaaatgagcagtatgacattgtgaaagttgttgtgctaatataccgcaggctattggtctcttgtaatgaacaaatgccgttactggcaaatagtttattaagcatcatacaaacacttttggatcaatcaaggcaggatgacatgtgcatcattggctgtgaaaccttgtttgatttcatagtcactcaggtggatggtacatatcagttcaatttggaagagtttattccaagactctgcaaactttctcaaatagtaagggacaaagagaaggctaatgcactccgtgcagcagctctgcaatcactctctgctatgatctggtttatgggtgagctctctcatatctcctcagagtttgatagcgttgtccaagtagtattggaaagctatgagcctcgacaggtgcaaagtgacaatagtgccactgaaaatccaggttgtcagttggttgaagaggtccttaaacccgagggtcatgcctctccatcgacatttatattttctgtgataccttcttgggacagcatagttagtgactatggaggaattcaactgcttatggatgatgccaaggatccttatttttggtcaagggtctgtgtgcataacatggccaagctgtccagggaagcaactacattccgccgtgttatggagtccctattttgccacttcgataatactaattcatggtcatccaaaaatggtcttgcactttgtgttctattggacatgcaaatgttcatggaaaagtcagggacaaacattaatttgatgatatcagtactagttaagcatctcgaacacaaggccatactgaaacaacctgagatgcaactcagcattgtcgaagtgataactgctcttgcagaacaatcaagagctcaggcttcagcagcaaccatagttgctataagtgaccttgtgaggcatatgaaaaagacactgcatttagctcttggcagcaacgatttggaggtggtaaagtggaatgacaaactccgcatggcttttgatgaatgcatagtccagctgtcaaagaaggtaggtgatgctggaccagttcttgacatgatgtctgtgatgctagagaacatatcacacactcctcttattgctatagcaactacttctgctgtttatcgcacagctcaaataattgcttcaataccaaatttgtcatataagaacaaggtatttccagaagcactttttcatcaattgctgttagcgatggttcaccctgatcatgaaacacgtgttggtgcacaccgcatattttctgttgtccttgtcccatcttctgtttctccttttcccaatttgaaatccctagatcagtgtagaaagcatgatgtccagaggacactctcgagggttgtatctgtcttctcatcttcagctgctttatttgataagctgagaagggacagaaactcctttagagaatatttacatgaaggaagcatgaacagaattttgcatggtattgatgatgaaattgctacccctaatgacttgccaggctcgcaaagcttgagacaaagcctcagactttcttcagtgtctcacaaacattcttatacttctttaaaggaaggtcaaagtcccttgacagagtcaatcaacgaaatggaaacaattgtgttaagactaagcagccagcaggccactcttctgctctcatctatttggcgtcaagcactttctccaaaaaatgctcctcaaaactacgaagctattgctcatacatatagtttgcttctattgtttttgggatcaaagacaccaatttttgaggttcttgctcccagctttcagattgcattttctttaatgagccattcacttggaggaacagattcattgccaccatctcgccgccggtcattatttactctggctacatctatgattgtttttgcctcaagagctttcaatgtggcacctcttctcccaatttgtaaattaatgctcaatgatggaacgatggatccattccttcatctggtacatgagaacaaacttcaggctgtgaaggactatacggaagatccatcaacatcctatggctcacccgaggacaatcagaatgccttgaaatctctttcagtggtggaactaacaaatagttgctcccgagaatccatgattttaaccattatgaactccataagagatttaccagacttggagttagagaatataaggagtcaactgctgcgtgatttctcccctgatgacgtgtgcccaagtagcgctcactttcttgaatcacctggcaagattgcaccgccatgttctgatgatgacaccgactacgactatcaagaggctgaacttatcgatctgagaaatgacaacaatacttatttggaagcctctgcaactacactggcggctatagctattcctgtgcccacaacaaatcttctcagtatcgatgaacttctagaaacagtcgtgaatgatgtgtcatctcagaccggagggcaatgtttggtgtcaatggccggagacatcccattccaggagatgactagccactgtgaggccttttcgatgggaaagcaccacaagatgtccctgctcatgagcttcaagcaaaacaagcaagcggccatggtcgtcgtgcctgacaatcaggttagccacgctgaagcagcacatacctccgacaagcaggtgcatggacca

SEQ ID NO: 12 - DNA, 3599 bp, Zea Mays
cctgcacgatgcaggtcgaggcgggagaaaggcggttggggctccccggtgggcaggggggggggggggggggtcggaggcggggatggggctcgacggcacggtctcgggggtggtgtcgaggaaggtgctgccggcgtgtggtgggctctgctgcctctgcccttcgctgcgtccccgctccaggcagcccgtcaagcgctacaagaagatcctcatcgacatctttcccgcggagcaggaagacggaccaaatgtgaggaggattgggaggctttgcgagtatgttgctagaaatcctcatcgcgtgccaaaggcgggctgtgcttctcacctcaagcgtcctacaaattgcatctaatctgttacttccacttcacttgttttctcatgcgtattggtgtctgtgcagatcacagcttacttggagaggaggtgttacagggagttgagaaatgagcagtatgacattgtgaaagttgttgtgctaatataccgcaggctattggtctcttgtaatgaacaaatgccgttactggcaaatagtttattaagcatcatacaaacacttttggatcaatcaaggcaggatgacatgtgcatcattggctgtgaaaccttgtttgatttcatagtcactcaggtggatggtacatatcagttcaatttggaagagtttattccaagactctgcaaactttctcaaatagtaagggacaaagagaaggctaatgcactccgtgcagcagctctgcaatcactctctgctatgatctggtttatgggtgagctctctcatatctcctcagagtttgatagcgttgtccaagtagtattggaaagctatgagcctcgacaggtgcaaagtgacaatagtgccactgaaaatccaggttgtcagttggttgaagaggtccttaaacccgagggtcatgcctctccatcgacatttatattttctgtgataccttcttgggacagcatagttagtgactatggaggaattcaactgcttatggatgatgccaaggatccttatttttggtcaagggtctgtgtgcataacatggccaagctgtccagggaagcaactacattccgccgtgttatggagtccctattttgccacttcgataatactaattcatggtcatccaaaaatggtcttgcactttgtgttctattggacatgcaaatgttcatggaaaagtcagggacaaacattaatttgatgatatcagtactagttaagcatctcgaacacaaggccatactgaaacaacctgagatgcaactcagcattgtcgaagtgataactgctcttgcagaacaatcaagagctcaggcttcagcagcaaccatagttgctataagtgaccttgtgaggcatatgaaaaagacactgcatttagctcttggcagcaacgatttggaggtggtaaagtggaatgacaaactccgcatggcttttgatgaatgcatagtccagctgtcaaagaaggtaggtgatgctggaccagttcttgacatgatgtctgtgatgctagagaacatatcacacactcctcttattgctatagcaactacttctgctgtttatcgcacagctcaaataattgcttcaataccaaatttgtcatataagaacaaggtatttccagaagcactttttcatcaattgctgttagcgatggttcaccctgatcatgaaacacgtgttggtgcacaccgcatattttctgttgtccttgtcccatcttctgtttctccttttcccaatttgaaatccctagatcagtgtagaaagcatgatgtccagaggacactctcgagggttgtatctgtcttctcatcttcagctgctttatttgataagctgagaagggacagaaactcctttagagaatatttacatgaaggaagcatgaacagaattttgcatggtattgatgatgaaattgctacccctaatgacttgccaggctcgcaaagcttgagacaaagcctcagactttcttcagtgtctcacaaacattcttatacttctttaaaggaaggtcaaagtcccttgacagagtcaatcaacgaaatggaaacaattgtgttaagactaagcagccagcaggccactcttctgctctcatctatttggcgtcaagcactttctccaaaaaatgctcctcaaaactacgaagctattgctcatacatatagtttgcttctattgtttttgggatcaaagacaccaatttttgaggttcttgctcccagctttcagattgcattttctttaatgagccattcacttggaggaacagattcattgccaccatctcgccgccggtcattatttactctggctacatctatgattgtttttgcctcaagagctttcaatgtggcacctcttctcccaatttgtaaattaatgctcaatgatggaacgatggatccattccttcatctggtacatgagaacaaacttcaggctgtgaaggactatacggaagatccatcaacatcctatggctcacccgaggacaatcagaatgccttgaaatctctttcagtggtggaactaacaaatagttgctcccgagaatccatgattttaaccattatgaactccataagagatttaccagacttggagttagagaatataaggagtcaactgctgcgtgatttctcccctgatgacgtgtgcccaagtagcgctcactttcttgaatcacctggcaagattgcaccgccatgttctgatgatgacaccgactacgactatcaagaggctgaacttatcgatctgagaaatgacaacaatacttatttggaagcctctgcaactacactggcggctatagctattcctgtgcccacaacaaatcttctcagtatcgatgaacttctagaaacagtcgtgaatgatgtgtcatctcagaccggagggcaatgtttggtgtcaatggccggagacatcccattccaggagatgactagccactgtgaggccttttcgatgggaaagcaccacaagatgtccctgctcatgagcttcaagcaaaacaagcaagcggccatggtcgtcgtgcctgacaatcaggttagccacgctgaagcagcacatacctccgacaagcagagcacaaacccgttcctcctgcagagcatcagtgccggcgaggcacaggttgctggcgacgtccagcagccgttcctgaggctgccaccgtcgagcccctacgacaacttcctcaaggctgctggctgctgatttccacttgcagaaaccctgccgtgtaaccaaccgaatgtatcgtgtgtgtacagtggccgtctgcctcaatcttattacaaactaaacaagggtttggatattacatgctgacttgttttcggatcatgccagggtcaatccaaaattcatttaattgtaggattccaaagcaaagggaatgatagatatataaggagaaaatgttgaaatctaacttagatcgtctccaacggcttatctatatggccgtactaacactgttttacattgtatactgtatcgttggtagagtgaaggttaaatataagaataaagaagatag

SEQ ID NO: 13 - DNA, 3620 bp, Zea Mays
cctgcacgatgcaggtcgaggcgggagaaaggcggttggggctccccggtgggcaggggggggggggggggggtcggaggcggggatggggctcgacggcacggtctcgggggtggtgtcgaggaaggtgctgccggcgtgtggtgggctctgctgcctctgcccttcgctgcgtccccgctccaggcagcccgtcaagcgctacaagaagatcctcatcgacatctttcccgcggagcaggaagacggaccaaatgtgaggaggattgggaggctttgcgagtatgttgctagaaatcctcatcgcgtgccaaaggcgggctgtgcttctcacctcaagcgtcctacaaattgcatctaatctgttacttccacttcacttgttttctcatgcgtattggtgtctgtgcagatcacagcttacttggagaggaggtgttacagggagttgagaaatgagcagtatgacattgtgaaagttgttgtgctaatataccgcaggctattggtctcttgtaatgaacaaatgccgttactggcaaatagtttattaagcatcatacaaacacttttggatcaatcaaggcaggatgacatgtgcatcattggctgtgaaaccttgtttgatttcatagtcactcaggtggatggtacatatcagttcaatttggaagagtttattccaagactctgcaaactttctcaaatagtaagggacaaagagaaggctaatgcactccgtgcagcagctctgcaatcactctctgctatgatctggtttatgggtgagctctctcatatctcctcagagtttgatagcgttgtccaagtagtattggaaagctatgagcctcgacaggtgcaaagtgacaatagtgccactgaaaatccaggttgtcagttggttgaagaggtccttaaacccgagggtcatgcctctccatcgacatttatattttctgtgataccttcttgggacagcatagttagtgactatggaggaattcaactgcttatggatgatgccaaggatccttatttttggtcaagggtctgtgtgcataacatggccaagctgtccagggaagcaactacattccgccgtgttatggagtccctattttgccacttcgataatactaattcatggtcatccaaaaatggtcttgcactttgtgttctattggacatgcaaatgttcatggaaaagtcagggacaaacattaatttgatgatatcagtactagttaagcatctcgaacacaaggccatactgaaacaacctgagatgcaactcagcattgtcgaagtgataactgctcttgcagaacaatcaagagctcaggcttcagcagcaaccatagttgctataagtgaccttgtgaggcatatgaaaaagacactgcatttagctcttggcagcaacgatttggaggtggtaaagtggaatgacaaactccgcatggcttttgatgaatgcatagtccagctgtcaaagaaggtaggtgatgctggaccagttcttgacatgatgtctgtgatgctagagaacatatcacacactcctcttattgctatagcaactacttctgctgtttatcgcacagctcaaataattgcttcaataccaaatttgtcatataagaacaaggtatttccagaagcactttttcatcaattgctgttagcgatggttcaccctgatcatgaaacacgtgttggtgcacaccgcatattttctgttgtccttgtcccatcttctgtttctccttttcccaatttgaaatccctagatcagtgtagaaagcatgatgtccagaggacactctcgagggttgtatctgtcttctcatcttcagctgctttatttgataagctgagaagggacagaaactcctttagagaatatttacatgaaggaagcatgaacagaattttgcatggtattgatgatgaaattgctacccctaatgacttgccaggctcgcaaagcttgagacaaagcctcagactttcttcagtgtctcacaaacattcttatacttctttaaaggaaggtcaaagtcccttgacagagtcaatcaacgaaatggaaacaattgtgttaagactaagcagccagcaggccactcttctgctctcatctatttggcgtcaagcactttctccaaaaaatgctcctcaaaactacgaagctattgctcatacatatagtttgcttctattgtttttgggatcaaagacaccaatttttgaggttcttgctcccagctttcagattgcattttctttaatgagccattcacttggaggaacagattcattgccaccatctcgccgccggtcattatttactctggctacatctatgattgtttttgcctcaagagctttcaatgtggcacctcttctcccaatttgtaaattaatgctcaatgatggaacgatggatccattccttcatctggtacatgagaacaaacttcaggctgtgaaggactatacggaagatccatcaacatcctatggctcacccgaggacaatcagaatgccttgaaatctctttcagtggtggaactaacaaatagttgctcccgagaatccatgattttaaccattatgaactccataagagatttaccagacttggagttagagaatataaggagtcaactgctgcgtgatttctcccctgatgacgtgtgcccaagtagcgctcactttcttgaatcacctggcaagattgcaccgccatgttctgatgatgacaccgactacgactatcaagaggtacacggaaattttgagcaggctgaacttatcgatctgagaaatgacaacaatacttatttggaagcctctgcaactacactggcggctatagctattcctgtgcccacaacaaatcttctcagtatcgatgaacttctagaaacagtcgtgaatgatgtgtcatctcagaccggagggcaatgtttggtgtcaatggccggagacatcccattccaggagatgactagccactgtgaggccttttcgatgggaaagcaccacaagatgtccctgctcatgagcttcaagcaaaacaagcaagcggccatggtcgtcgtgcctgacaatcaggttagccacgctgaagcagcacatacctccgacaagcagagcacaaacccgttcctcctgcagagcatcagtgccggcgaggcacaggttgctggcgacgtccagcagccgttcctgaggctgccaccgtcgagcccctacgacaacttcctcaaggctgctggctgctgatttccacttgcagaaaccctgccgtgtaaccaaccgaatgtatcgtgtgtgtacagtggccgtctgcctcaatcttattacaaactaaacaagggtttggatattacatgctgacttgttttcggatcatgccagggtcaatccaaaattcatttaattgtaggattccaaagcaaagggaatgatagatatataaggagaaaatgttgaaatctaacttagatcgtctccaacggcttatctatatggccgtactaacactgttttacattgtatactgtatcgttggtagagtgaaggttaaatataagaataaagaagatag

SEQ ID NO: 14 - DNA, 3581 bp, Zea Mays
cctgcacgatgcaggtcgaggcgggagaaaggcggttggggctccccggtgggcaggggggggggggggggggtcggaggcggggatggggctcgacggcacggtctcgggggtggtgtcgaggaaggtgctgccggcgtgtggtgggctctgctgcctctgcccttcgctgcgtccccgctccaggcagcccgtcaagcgctacaagaagatcctcatcgacatctttcccgcggagcaggaagacggaccaaatgtgaggaggattgggaggctttgcgagtatgttgctagaaatcctcatcgcgtgccaaaggcgggctgtgcttctcacctcaagcgtcctacaaattgcatctaatctgttacttccacttcacttgttttctcatgcgtattggtgtctgtgcagatcacagcttacttggagaggaggtgttacagggagttgagaaatgagcagtatgacattgtgaaagttgttgtgctaatataccgcaggctattggtctcttgtaatgaacaaatgccgttactggcaaatagtttattaagcatcatacaaacacttttggatcaatcaaggcaggatgacatgtgcatcattggctgtgaaaccttgtttgatttcatagtcactcaggtggatggtacatatcagttcaatttggaagagtttattccaagactctgcaaactttctcaaatagtaagggacaaagagaaggctaatgcactccgtgcagcagctctgcaatcactctctgctatgatctggtttatgggtgagctctctcatatctcctcagagtttgatagcgttgtccaagtagtattggaaagctatgagcctcgacaggtgcaaagtgacaatagtgccactgaaaatccaggttgtcagttggttgaagaggtccttaaacccgagggtcatgcctctccatcgacatttatattttctgtgataccttcttgggacagcatagttagtgactatggaggaattcaactgcttatggatgatgccaaggatccttatttttggtcaagggtctgtgtgcataacatggccaagctgtccagggaagcaactacattccgccgtgttatggagtccctattttgccacttcgataatactaattcatggtcatccaaaaatggtcttgcactttgtgttctattggacatgcaaatgttcatggaaaagtcagggacaaacattaatttgatgatatcagtactagttaagcatctcgaacacaaggccatactgaaacaacctgagatgcaactcagcattgtcgaagtgataactgctcttgcagaacaatcaagagctcaggcttcagcagcaaccatagttgctataagtgaccttgtgaggcatatgaaaaagacactgcatttagctcttggcagcaacgatttggaggtggtaaagtggaatgacaaactccgcatggcttttgatgaatgcatagtccagctgtcaaagaaggtaggtgatgctggaccagttcttgacatgatgtctgtgatgctagagaacatatcacacactcctcttattgctatagcaactacttctgctgtttatcgcacagctcaaataattgcttcaataccaaatttgtcatataagaacaaggtatttccagaagcactttttcatcaattgctgttagcgatggttcaccctgatcatgaaacacgtgttggtgcacaccgcatattttctgttgtccttgtcccatcttctgtttctccttttcccaatttgaaatccctagatcagtgtagaaagcatgatgtccagaggacactctcgagggttgtatctgtcttctcatcttcagctgctttatttgataagctgagaagggacagaaactcctttagagaatatttacatgaaggaagcatgaacagaattttgcatggtattgatgatgaaattgctacccctaatgacttgccaggctcgcaaagcttgagacaaagcctcagactttcttcagtgtctcacaaacattcttatacttctttaaaggaaggtcaaagtcccttgacagagtcaatcaacgaaatggaaacaattgtgttaagactaagcagccagcaggccactcttctgctctcatctatttggcgtcaagcactttctccaaaaaatgctcctcaaaactacgaagctattgctcatacatatagtttgcttctattgtttttgggatcaaagacaccaatttttgaggttcttgctcccagctttcagattgcattttctttaatgagccattcacttggaggaacagattcattgccaccatctcgccgccggtcattatttactctggctacatctatgattgtttttgcctcaagagctttcaatgtggcacctcttctcccaatttgtaaattaatgctcaatgatggaacgatggatccattccttcatctggtacatgagaacaaacttcaggctgtgaaggactatacggaagatccatcaacatcctatggctcacccgaggacaatcagaatgccttgaaatctctttcagtggtggaactaacaaatagttgctcccgagaatccatgattttaaccattatgaactccataagagatttaccagacttggagttagagaatataaggagtcaactgctgcgtgatttctcccctgatgacgtgtgcccaagtagcgctcactttcttgaatcacctggcaagattgcaccgccatgttctgatgatgacaccgactacgactatcaagaggtacacggaaattttgagcaggctgaacttatcgatctgagaaatgacaacaatacttatttggaagcctctgcaactacactggcggctatagctattcctgtgcccacaacaaatcttctcagtatcgatgaacttctagaaacagtcgtgaatgatgtgtcatctcagaccggagggcaatgtttggtgtcaatggccggagacatcccattccaggagatgactagccactgtgaggccttttcgatgggaaagcaccacaagatgtccctgctcatgagcttcaagcaaaacaagcaagcggccatggtcgtcgtgcctgacaatcagagcacaaacccgttcctcctgcagagcatcagtgccggcgaggcacaggttgctggcgacgtccagcagccgttcctgaggctgccaccgtcgagcccctacgacaacttcctcaaggctgctggctgctgatttccacttgcagaaaccctgccgtgtaaccaaccgaatgtatcgtgtgtgtacagtggccgtctgcctcaatcttattacaaactaaacaagggtttggatattacatgctgacttgttttcggatcatgccagggtcaatccaaaattcatttaattgtaggattccaaagcaaagggaatgatagatatataaggagaaaatgttgaaatctaacttagatcgtctccaacggcttatctatatggccgtactaacactgttttacattgtatactgtatcgttggtagagtgaaggttaaatataagaataaagaagatag

SEQ ID NO: 15 - DNA, 553 bp, Zea Mays
cagccttctctctttgtttgtttataccgccatctgtgtgcacattacaggtcgtgaatgatgtgtcatctcagaccggagggcaatgtttggtgtcaatggccggagacatcccattccaggagatgactagccactgtgaggccttttcgatgggaaagcaccacaagatgtccctgctcatgagcttcaagcaaaacaagcaagcggccatggtcgtcgtgcctgacaatcaggttagccacgctgaagcagcacatacctccgacaagcaggtgcatggaccagcttagtttcgagctcgtaatctgcattttcacaaacgcttaactgcaaatcggggcggaaatatctgggtgatgagatgggttggggaatttcagatgggtgagatgatgaggctgactgttgccgatttgttttcagagcacaaacccgttcctcctgcagagcatcagtgccggcgaggcacaggttgctggcgacgtccagcagccgttcctgaggctgccaccgtcgagcccctacgacaacttcctcaaggctgctggct

SEQ ID NO: 16 - DNA, 6466 bp, Zea Mays
taacaacatccaaaaatatgataacatatcaaaataattgattggcaaataatgctgaaactcatcaatacggttattctggtctagtaacaagcaaacataaatgagagcattttctcacagatagcctttcagcagttaccgcgaactagaaacatcaagatatcaaacactgcttcaacagaagatattccagcacaaacaataacaagcacagaaactattaagaatctaatcgacagagctagtacactagatcgtatagcttgtttgcttcagtgatgatccaggaaaatggaatgaatcacgttgtatatcatgaggatatcttgcaaatgtcctcgtattcgacagccctgagaaccttcccatcatagaggcctttctcaacctgcacttttgcacagaatttctcagtgtccactgaaagcaacctggcatttgacccccgataagccccattgacaatccgcacaagtccaccaatctgagggatcacggtctcaagctcatcttggtcgaccctgagaacatgcttgctctccaacatctcaatctccccaacatatttatcaataactttcttcaccacccctttctgcttgtagtaccccttctctgccaatgacttgctcatcactttgaccacaatcccagggcacagccagtagtccttcctattgctcctctccttggccttctcctcctccttcatcagctcgtccaatgctgacctctttgcctctgctgccttcacatcctttcccatcttcttggtcaactcattcttctcctggtctcgggtgcctgagccatcctcctcatcaaaaccaaatttcatcttcggcttatcgtcaaaaggattaaccttgggccccggcacagccttctgaagcgcaatcgcaatcttacctgttgccttatctgcctctttcgagtcatcctccggctcctgctcatcatcatccgaacctgaatactctccttcactgccagactcaggctcgccctcggcagcaccaccaccattgggtttagctaaggacttgtgcgcacgctcaatctggcgggcaatcatgcgctcctggcgctcgtcgtcagccatgtctgacttgatcctcttgcgcttgaggcgttccttgacggcctgctccgagtcacggtcgatgtaggtcatgaaccaccccttgggcgtgtcctcgaccttacagtacccctcgcgccccaggaacttgacgaactcggtgagcgtggcccaccgcgtggagttcatgtggacgtggtgccggtcggcgatgtactcgttgtagacgacggtggcggcgacgcgggagtggcggtgcgcgcggcggatgagggagaggaaggactcgaggaactcctcggagaagccctcgacgacgcggtcgggggccatgccgaacacctgcatctgcctctggtgcgactccgacatgcagtggcacttgaacccgttctcgtcgcggcactgcttctgacacatctgacagtaccaccgcagcttctgcagccccttcgccttgatccggtttgcgatcgccttcggcgtcaggaactcgtgcttccccatcgtgcgggagaggcccttgccgcacaagcaggatgggaattacaggtagaagaaggggggagcacgttggtcaaggagacggacgcgaggcgacgaggagtggattattattgtggagagaggcagcggcggaggccggagaggaggccggcgacggcgagattggggagtgcgtgaacggattggggatcgattggattggggcgagggctttgtttttttttgttgctttttttgtttttttattagacaggcgagggctttgttgggacttgggaataagtccaaggctagcaccacaaatgaacgatccggatcgcgtaaacgatcaatcaacggacgagatccagccaccgtgccagatttttcaacccaacgcatgtgaagggcgcgcatcgtatcttatcttcactctccgtccaccaaagcaaaccctacccgctcccttcccgcgccgccgccgccatggactcgatcgacgcagatctcgcgcgcacgcaagaggagcggcgcaggatggaggaggcgctggcggctggcgcgcccatggccgtgtcctccgtcaccttcgacaccgacctctacggcggcgggggcgccgaccccaaccgcttcgcgggctacgacacctccatcccggcctccgaggacgacgccgcggaggacgacgcggaggccgccaaccctgcgccgcgccgcctcgcggcctacacgggccacgccatcgccgccgccgacatcccgcggtcggccgacgacgacgacgggctgcccaagaggtcccagcgcatcatcgaccgcgaggacgactaccgccgccgccgcctcaaccagatcatctcgccggagcgccatgacccgttcgccgctggggaggccaccccggacccctcggtgcggacctacgctgacgtcatgcgcgacgcggcgctgcagaagaagaaggaggacctgctgagggagattgccaagaagaagaaggaagaggaagagaaggagaaggagaggaaggctgccgctcctgagcagcctgccgccacaacaaagcggcgcaacaggtgggatcagtcgcaggacggcgacgctggtgccggtgccaagaaggtgaagacatcctcggactgggatgcccctgatgcgactcctgggattggccgttgggatgccacccccggacgtgttggagacgccacaccctccgtgagaaggaacagatgggatgagacaccgactccagggaggatggccgatgctgatgctacgcctgcagctggcggtgccacccctggggctactccttctggggcttgggacgcgactccaaagctgcctggtggtgtcacgccaacccctggtaagaagcagagatcaaggtgggatgagacaccagcaagtatggggagtgcaacccctggtagtcttggtgctgcaacacctgctggttatactcctggtccaacgccatttggtgcagagaaccttgccacaccaactcctagccagattgctcgtggaccgatcactccggagcagtaccagctcatgcggtgggagcgggacattgaggagaggaacaggcctctcactgacgaggagcttgatgccatgttcccgcaggagggctacaagattcttgagcccccggcttcctaccagcccatcaggaccccggcaaggaagctccttgcgacaccgacacctctggggacaccactttatgctattccagaggagaatcgtgggcagcattttgatgtgcccaaggagctgcctggtgggttgccactcatgaagcccgaggattaccagtactttggaactttgctgaacgaggaagaggaggagcagctatcgccagaggagcagaaggagaggaaaatcatgaaactgttactcaaagtgaagaatggcacacccccacagcgtaaaacagcacttcggcaactgacagacaaagcccgtgaatttggtgcaggaccgttgttcaacaaaatactgcccttactcatgcagccaacactggaggaccaggagaggcatcttttggtgaaggtcattgacagagtactttataagctcgatgagctggtccgtccttttgtgcacaagattcttgtggttattgaaccactgttgattgatgaggactattatgctcgtgttgaaggcagggagatcatctcaaaccttagcaaagcagctgggcttgctactatgattgctgctatgcgacccgacatcgataacattgatgagtatgtgagaaacaccactgctagggcgttcagtgtggtggcttctgctttgggtatccctgcccttttaccattcttgaaggctgtctgtcagagtaagaagtcttggcaggctaggcacactggtatcaaaatcgtccaacagattgctattctcatgggctgtgctgttttgccacacctcaagtcactagttgagatcattgagcatgggctgagcgatgaaaaccagaaagttcgtacaattactgccctttctcttgctgcacttgctgaggctgctgcaccatatggtatagaaagttttgatactgtattgaaacctctgtggaagggtatcagatctcaccgtgggaaggtccttgctgccttcctaaaggccattggtttcatcatccctcttatggatgctctgtatgctagctactacacaaaggaggtgatgcaggtcctcattagggagttccagtctccagatgaagaaatgaagaaaattgttctcaaggtggtgaaacagtgtgtcagtacagagggtgtggaggctgattatatccggaatgacatccttccagatttcttcaagcacttctgggtgaggagaatggctctagatcgcaggaactataagcagcttgtggaaactacagttgagatggcaaacaaggttggagttgctgatattgttgggagggttgttgaggatctgaaagatgaaagtgagccctacagaagaatggtgatggaaacaatcgagaaggtggtagccaacttgggtgcatcagatattgatgctcgtctggaggagctgcttattgatggtatcttgtatgctttccaagagcagactagtgatgacgcaaatgttatgctaaatggttttggagctgtggttaatgcacttggacagagagttaagccctaccttcctcagatttgtggtactatcaagtggcgattgaacaacaagagtgcaaaagttaggcagcaagctgctgatctgatctccaggatagccatagtaatgaagcagtgccaggaggagcagcttatgggtcacttgggtgttgtgctgtatgagtacttaggagaggagtatcctgaggtgcttggttcaattcttggagccttgaaggctatcgtcaatgtcattggtatgactaaaatgactccaccaatcaaggatcttcttcctcgtctgacccccattcttaagaacaggcatgagaaggtccaagagaactgcattgatcttgttggtaggattgctgatcgtggagcagaatttgtgccagcaagggaatggatgaggatttgttttgagctgctcgaaatgttgaaggctcataagaagggtattaggagagcaactgtgaacacatttggttatatcgcaaaggctatagggccacaggatgtgttggccaccctgttgaataacttgaaggtgcaagaacgacagaaccgggtctgtacaactgtagctattgctatagttgctgaaacttgctcacctttcacagttttacctgcccttatgaatgagtaccgggtcccagagctcaatgtccaaaatggtgttctgaagtcactctctttcctctttgagtatattggtgagatgggcaaagattacatatatgccgtcacccccttacttgaagatgctttaatggatagagatctggttcaccggcagactgctgcatctgctgttaagcacatggctctaggtgttgctggcttgggttgtgaggatgctcttgttcatctgcttaactatgtttggcccaacatatttgagacatctccccacgttataaatgctgtcatggaggcaattgaggggatgagggtcgcactaggtgcggctgtgattttaaattattgcctgcaaggtctcttccatccagcaaggaaagtacgagaagtgtattggaagatatacaactctttgtacatcggcgcgcaggatgcacttgttgcttcttatcctgccctggaagacgatggggataacatctttagtcgtccagagttggcaatgtttgtctgattaacgctggatgtgcatgtccatgtgtcttcatccatattcttatgaagcttgaactgggtggtactctgagttagagctttgtattttacttggtgacacctcttgtgatgcatgtaattgaagttgcatctatttttttgtatttgcaggattgttccttctgaagggggtgcaatgtttaggaattttttttcctggtttactataatgcaactcaaaatctctatcatagtctggtcttactaacgatttgggaactgttttgttttcagggtacctcatgttgcagctgctgaagcgttacactggatttaggaccaatcctaaggctgcagcatgccaattaatccatcaagatcctatattgtgaaggacaaatgacaatcctagcgcgctgtcatctttttatgaatattaggcgttgggcatttaccgtgttttaaaactttgtattacacatggatgttgtattatgtggtgtggacaatggaacgttgcaagctgacctgaacctgattccttactgtattactgagatgttgatatgcatgtcatgttagtgta

SEQ ID NO: 17 - DNA, 6307 bp, Zea Mays
taacaacatccaaaaatatgataacatatcaaaataattgattggcaaataatgctgaaactcatcaatacggttattctggtctagtaacaagcaaacataaatgagagcattttctcacagatagcctttcagcagttaccgcgaactagaaacatcaagatatcaaacactgcttcaacagaagatattccagcacaaacaataacaagcacagaaactattaagaatctaatcgacagagctagtacactagatcgtatagcttgtttgcttcagtgatgatccaggaaaatggaatgaatcacgttgtatatcatgaggatatcttgcaaatgtcctcgtattcgacagccctgagaaccttcccatcatagaggcctttctcaacctgcacttttgcacagaatttctcagtgtccactgaaagcaacctggcatttgacccccgataagccccattgacaatccgcacaagtccaccaatctgagggatcacggtctcaagctcatcttggtcgaccctgagaacatgcttgctctccaacatctcaatctccccaacatatttatcaataactttcttcaccacccctttctgcttgtagtaccccttctctgccaatgacttgctcatcactttgaccacaatcccagggcacagccagtagtccttcctattgctcctctccttggccttctcctcctccttcatcagctcgtccaatgctgacctctttgcctctgctgccttcacatcctttcccatcttcttggtcaactcattcttctcctggtctcgggtgcctgagccatcctcctcatcaaaaccaaatttcatcttcggcttatcgtcaaaaggattaaccttgggccccggcacagccttctgaagcgcaatcgcaatcttacctgttgccttatctgcctctttcgagtcatcctccggctcctgctcatcatcatccgaacctgaatactctccttcactgccagactcaggctcgccctcggcagcaccaccaccattgggtttagctaaggacttgtgcgcacgctcaatctggcgggcaatcatgcgctcctggcgctcgtcgtcagccatgtctgacttgatcctcttgcgcttgaggcgttccttgacggcctgctccgagtcacggtcgatgtaggtcatgaaccaccccttgggcgtgtcctcgaccttacagtacccctcgcgccccaggaacttgacgaactcggtgagcgtggcccaccgcgtggagttcatgtggacgtggtgccggtcggcgatgtactcgttgtagacgacggtggcggcgacgcgggagtggcggtgcgcgcggcggatgagggagaggaaggactcgaggaactcctcggagaagccctcgacgacgcggtcgggggccatgccgaacacctgcatctgcctctggtgcgactccgacatgcagtggcacttgaacccgttctcgtcgcggcactgcttctgacacatctgacagtaccaccgcagcttctgcagccccttcgccttgatccggtttgcgatcgccttcggcgtcaggaactcgtgcttccccatcgtgcgggagaggcccttgccgcacaagcaggatgggaattacaggtagaagaaggggggagcacgttggtcaaggagacggacgcgaggcgacgaggagtggattattattgtggagagaggcagcggcggaggccggagaggaggccggcgacggcgagattggggagtgcgtgaacggattggggatcgattggattggggcgagggctttgtttttttttgttgctttttttgtttttttattagacaggcgagggctttgttgggacttgggaataagtccaaggctagcaccacaaatgaacgatccggatcgcgtaaacgatcaatcaacggacgagatccagccaccgtgccagatttttcaacccaacgcatgtgaagggcgcgcatcgtatcttatcttcactctccgtccaccaaagcaaaccctacccgctcccttcccgcgccgccgccgccatggactcgatcgacgcagatctcgcgcgcacgcaagaggagcggcgcaggatggaggaggcgctggcggctggcgcgcccatggccgtgtcctccgtcaccttcgacaccgacctctacggcggcgggggcgccgaccccaaccgcttcgcgggctacgacacctccatcccggcctccgaggacgacgccgcggaggacgacgcggaggccgccaaccctgcgccgcgccgcctcgcggcctacacgggccacgccatcgccgccgccgacatcccgcggtcggccgacgacgacgacgggctgcccaagaggtcccagcgcatcatcgaccgcgaggacgactaccgccgccgccgcctcaaccagatcatctcgccggagcgccatgacccgttcgccgctggggaggccaccccggacccctcggtgcggacctacgctgacgtcatgcgcgacgcggcgctgcagaagaagaaggaggacctgctgagggagattgccaagaagaagaaggaagaggaagagaaggagaaggagaggaaggctgccgctcctgagcagcctgccgccacaacaaagcggcgcaacaggtgggatcagtcgcaggacggcgacgctggtgccggtgccaagaaggtgaagacatcctcggactgggatgcccctgatgcgactcctgggattggccgttgggatgccacccccggacgtgttggagacgccacaccctccgtgagaaggaacagatgggatgagacaccgactccagggaggatggccgatgctgatgctacgcctgcagctggcggtgccacccctggggctactccttctggggcttgggacgcgactccaaagctgcctggtggtgtcacgccaacccctggtaagaagcagagatcaaggtgggatgagacaccagcaagtatggggagtgcaacccctggtagtcttggtgctgcaacacctgctggttatactcctggtccaacgccatttggtgcagagaaccttgccacaccaactcctagccagattgctcgtggaccgatcactccggagcagtaccagctcatgcggtgggagcgggacattgaggagaggaacaggcctctcactgacgaggagcttgatgccatgttcccgcaggagggctacaagattcttgagcccccggcttcctaccagcccatcaggaccccggcaaggaagctccttgcgacaccgacacctctggggacaccactttatgctattccagaggagaatcgtgggcagcattttgatgtgcccaaggagctgcctggtgggttgccactcatgaagcccgaggattaccagtactttggaactttgctgaacgaggaagaggaggagcagctatcgccagaggagcagaaggagaggaaaatcatgaaactgttactcaaagtgaagaatggcacacccccacagcgtaaaacagcacttcggcaactgacagacaaagcccgtgaatttggtgcaggaccgttgttcaacaaaatactgcccttactcatgcagccaacactggaggaccaggagaggcatcttttggtgaaggtcattgacagagtactttataagctcgatgagctggtccgtccttttgtgcacaagattcttgtggttattgaaccactgttgattgatgaggactattatgctcgtgttgaaggcagggagatcatctcaaaccttagcaaagcagctgggcttgctactatgattgctgctatgcgacccgacatcgataacattgatgagtatgtgagaaacaccactgctagggcgttcagtgtggtggcttctgctttgggtatccctgcccttttaccattcttgaaggctgtctgtcagagtaagaagtcttggcaggctaggcacactggtatcaaaatcgtccaacagattgctattctcatgggctgtgctgttttgccacacctcaagtcactagttgagatcattgagcatgggctgagcgatgaaaaccagaaagttcgtacaattactgccctttctcttgctgcacttgctgaggctgctgcaccatatggtatagaaagttttgatactgtattgaaacctctgtggaagggtatcagatctcaccgtgggaaggtccttgctgccttcctaaaggccattggtttcatcatccctcttatggatgctctgtatgctagctactacacaaaggaggtgatgcaggtcctcattagggagttccagtctccagatgaagaaatgaagaaaattgttctcaaggtggtgaaacagtgtgtcagtacagagggtgtggaggctgattatatccggaatgacatccttccagatttcttcaagcacttctgggtgaggagaatggctctagatcgcaggaactataagcagcttgtggaaactacagttgagatggcaaacaaggttggagttgctgatattgttgggagggttgttgaggatctgaaagatgaaagtgagccctacagaagaatggtgatggaaacaatcgagaaggtggtagccaacttgggtgcatcagatattgatgctcgtctggaggagctgcttattgatggtatcttgtatgctttccaagagcagactagtgatgacgcaaatgttatgctaaatggttttggagctgtggttaatgcacttggacagagagttaagccctaccttcctcagatttgtggtactatcaagtggcgattgaacaacaagagtgcaaaagttaggcagcaagctgctgatctgatctccaggatagccatagtaatgaagcagtgccaggaggagcagcttatgggtcacttgggtgttgtgctgtatgagtacttaggagaggagtatcctgaggtgcttggttcaattcttggagccttgaaggctatcgtcaatgtcattggtatgactaaaatgactccaccaatcaaggatcttcttcctcgtctgacccccattcttaagaacaggcatgagaaggtccaagagaactgcattgatcttgttggtaggattgctgatcgtggagcagaatttgtgccagcaagggaatggatgaggatttgttttgagctgctcgaaatgttgaaggctcataagaagggtattaggagagcaactgtgaacacatttggttatatcgcaaaggctatagggccacaggatgtgttggccaccctgttgaataacttgaaggtgcaagaacgacagaaccgggtctgtacaactgtagctattgctatagttgctgaaacttgctcacctttcacagttttacctgcccttatgaatgagtaccgggtcccagagctcaatgtccaaaatggtgttctgaagtcactctctttcctctttgagtatattggtgagatgggcaaagattacatatatgccgtcacccccttacttgaagatgctttaatggatagagatctggttcaccggcagactgctgcatctgctgttaagcacatggctctaggtgttgctggcttgggttgtgaggatgctcttgttcatctgcttaactatgtttggcccaacatatttgagacatctccccacgttataaatgctgtcatggaggcaattgaggggatgagggtcgcactaggtgcggctgtgattttaaattattgcctgcaaggtctcttccatccagcaaggaaagtacgagaagtgtattggaagatatacaactctttgtacatcggcgcgcaggatgcacttgttgcttcttatcctgccctggaagacgatggggataacatctttagtcgtccagagttggcaatgtttgtctgattaacgctggatgtgcatgtccatgtgtcttcatccatattcttatgaagcttgaactgggtggtactctgagttagagctttgtattttacttggtgacacctcttgtgatgcatggtacctcatgttgcagctgctgaagcgttacactggatttaggaccaatcctaaggctgcagcatgccaattaatccatcaagatcctatattgtgaaggacaaatgacaatcctagcgcgctgtcatctttttatgaatattaggcgttgggcatttaccgtgttttaaaactttgtattacacatggatgttgtattatgtggtgtggacaatggaacgttgcaagctgacctgaacctgattccttactgtattactgagatgttgatatgcatgtcatgttagtgta

SEQ ID NO: 18 - DNA, 6251 bp, Zea Mays
taacaacatccaaaaatatgataacatatcaaaataattgattggcaaataatgctgaaactcatcaatacggttattctggtctagtaacaagcaaacataaatgagagcattttctcacagatagcctttcagcagttaccgcgaactagaaacatcaagatatcaaacactgcttcaacagaagatattccagcacaaacaataacaagcacagaaactattaagaatctaatcgacagagctagtacactagatcgtatagcttgtttgcttcagtgatgatccaggaaaatggaatgaatcacgttgtatatcatgaggatatcttgcaaatgtcctcgtattcgacagccctgagaaccttcccatcatagaggcctttctcaacctgcacttttgcacagaatttctcagtgtccactgaaagcaacctggcatttgacccccgataagccccattgacaatccgcacaagtccaccaatctgagggatcacggtctcaagctcatcttggtcgaccctgagaacatgcttgctctccaacatctcaatctccccaacatatttatcaataactttcttcaccacccctttctgcttgtagtaccccttctctgccaatgacttgctcatcactttgaccacaatcccagggcacagccagtagtccttcctattgctcctctccttggccttctcctcctccttcatcagctcgtccaatgctgacctctttgcctctgctgccttcacatcctttcccatcttcttggtcaactcattcttctcctggtctcgggtgcctgagccatcctcctcatcaaaaccaaatttcatcttcggcttatcgtcaaaaggattaaccttgggccccggcacagccttctgaagcgcaatcgcaatcttacctgttgccttatctgcctctttcgagtcatcctccggctcctgctcatcatcatccgaacctgaatactctccttcactgccagactcaggctcgccctcggcagcaccaccaccattgggtttagctaaggacttgtgcgcacgctcaatctggcgggcaatcatgcgctcctggcgctcgtcgtcagccatgtctgacttgatcctcttgcgcttgaggcgttccttgacggcctgctccgagtcacggtcgatgtaggtcatgaaccaccccttgggcgtgtcctcgaccttacagtacccctcgcgccccaggaacttgacgaactcggtgagcgtggcccaccgcgtggagttcatgtggacgtggtgccggtcggcgatgtactcgttgtagacgacggtggcggcgacgcgggagtggcggtgcgcgcggcggatgagggagaggaaggactcgaggaactcctcggagaagccctcgacgacgcggtcgggggccatgccgaacacctgcatctgcctctggtgcgactccgacatgcagtggcacttgaacccgttctcgtcgcggcactgcttctgacacatctgacagtaccaccgcagcttctgcagccccttcgccttgatccggtttgcgatcgccttcggcgtcaggaactcgtgcttccccatcgtgcgggagaggcccttgccgcacaagcaggatgggaattacaggtagaagaaggggggagcacgttggtcaaggagacggacgcgaggcgacgaggagtggattattattgtggagagaggcagcggcggaggccggagaggaggccggcgacggcgagattggggagtgcgtgaacggattggggatcgattggattggggcgagggctttgtttttttttgttgctttttttgtttttttattagacaggcgagggctttgttgggacttgggaataagtccaaggctagcaccacaaatgaacgatccggatcgcgtaaacgatcaatcaacggacgagatccagccaccgtgccagatttttcaacccaacgcatgtgaagggcgcgcatcgtatcttatcttcactctccgtccaccaaagcaaaccctacccgctcccttcccgcgccgccgccgccatggactcgatcgacgcagatctcgcgcgcacgcaagaggagcggcgcaggatggaggaggcgctggcggctggcgcgcccatggccgtgtcctccgtcaccttcgacaccgacctctacggcggcgggggcgccgaccccaaccgcttcgcgggctacgacacctccatcccggcctccgaggacgacgccgcggaggacgacgcggaggccgccaaccctgcgccgcgccgcctcgcggcctacacgggccacgccatcgccgccgccgacatcccgcggtcggccgacgacgacgacgggctgcccaagaggtcccagcgcatcatcgaccgcgaggacgactaccgccgccgccgcctcaaccagatcatctcgccggagcgccatgacccgttcgccgctggggaggccaccccggacccctcggtgcggacctacgctgacgtcatgcgcgacgcggcgctgcagaagaagaaggaggacctgctgagggagattgccaagaagaagaaggaagaggaagagaaggagaaggagaggaaggctgccgctcctgagcagcctgccgccacaacaaagcggcgcaacaggtgggatcagtcgcaggacggcgacgctggtgccggtgccaagaaggtgaagacatcctcggactgggatgcccctgatgcgactcctgggattggccgttgggatgccacccccggacgtgttggagacgccacaccctccgtgagaaggaacagatgggatgagacaccgactccagggaggatggccgatgctgatgctacgcctgcagctggcggtgccacccctggggctactccttctggggcttgggacgcgactccaaagctgcctggtggtgtcacgccaacccctggtaagaagcagagatcaaggtgggatgagacaccagcaagtatggggagtgcaacccctggtagtcttggtgctgcaacacctgctggttatactcctggtccaacgccatttggtgcagagaaccttgccacaccaactcctagccagattgctcgtggaccgatcactccggagcagtaccagctcatgcggtgggagcgggacattgaggagaggaacaggcctctcactgacgaggagcttgatgccatgttcccgcaggagggctacaagattcttgagcccccggcttcctaccagcccatcaggaccccggcaaggaagctccttgcgacaccgacacctctggggacaccactttatgctattccagaggagaatcgtgggcagcattttgatgtgcccaaggagctgcctggtgggttgccactcatgaagcccgaggattaccagtactttggaactttgctgaacgaggaagaggaggagcagctatcgccagaggagcagaaggagaggaaaatcatgaaactgttactcaaagtgaagaatggcacacccccacagcgtaaaacagcacttcggcaactgacagacaaagcccgtgaatttggtgcaggaccgttgttcaacaaaatactgcccttactcatgcagccaacactggaggaccaggagaggcatcttttggtgaaggtcattgacagagtactttataagctcgatgagctggtccgtccttttgtgcacaagattcttgtggttattgaaccactgttgattgatgaggactattatgctcgtgttgaaggcagggagatcatctcaaaccttagcaaagcagctgggcttgctactatgattgctgctatgcgacccgacatcgataacattgatgagtatgtgagaaacaccactgctagggcgttcagtgtggtggcttctgctttgggtatccctgcccttttaccattcttgaaggctgtctgtcagagtaagaagtcttggcaggctaggcacactggtatcaaaatcgtccaacagattgctattctcatgggctgtgctgttttgccacacctcaagtcactagttgagatcattgagcatgggctgagcgatgaaaaccagaaagttcgtacaattactgccctttctcttgctgcacttgctgaggctgctgcaccatatggtatagaaagttttgatactgtattgaaacctctgtggaagggtatcagatctcaccgtgggaaggtccttgctgccttcctaaaggccattggtttcatcatccctcttatggatgctctgtatgctagctactacacaaaggaggtgatgcaggtcctcattagggagttccagtctccagatgaagaaatgaagaaaattgttctcaaggtggtgaaacagtgtgtcagtacagagggtgtggaggctgattatatccggaatgacatccttccagatttcttcaagcacttctgggtgaggagaatggctctagatcgcaggaactataagcagcttgtggaaactacagttgagatggcaaacaaggttggagttgctgatattgttgggagggttgttgaggatctgaaagatgaaagtgagccctacagaagaatggtgatggaaacaatcgagaaggtggtagccaacttgggtgcatcagatattgatgctcgtctggaggagctgcttattgatggtatcttgtatgctttccaagagcagactagtgatgacgcaaatgttatgctaaatggttttggagctgtggttaatgcacttggacagagagttaagccctaccttcctcagatttgtggtactatcaagtggcgattgaacaacaagagtgcaaaagttaggcagcaagctgctgatctgatctccaggatagccatagtaatgaagcagtgccaggaggagcagcttatgggtcacttgggtgttgtgctgtatgagtacttaggagaggagtatcctgaggtgcttggttcaattcttggagccttgaaggctatcgtcaatgtcattggtatgactaaaatgactccaccaatcaaggatcttcttcctcgtctgacccccattcttaagaacaggcatgagaaggtccaagagaactgcattgatcttgttggtaggattgctgatcgtggagcagaatttgtgccagcaagggaatggatgaggatttgttttgagctgctcgaaatgttgaaggctcataagaagggtattaggagagcaactgtgaacacatttggttatatcgcaaaggctatagggccacaggatgtgttggccaccctgttgaataacttgaaggtgcaagaacgacagaaccgggtctgtacaactgtagctattgctatagttgctgaaacttgctcacctttcacagttttacctgcccttatgaatgagtaccgggtcccagagctcaatgtccaaaatggtgttctgaagtcactctctttcctctttgagtatattggtgagatgggcaaagattacatatatgccgtcacccccttacttgaagatgctttaatggatagagatctggttcaccggcagactgctgcatctgctgttaagcacatggctctaggtgttgctggcttgggttgtgaggatgctcttgttcatctgcttaactatgtttggcccaacatatttgagacatctccccacgttataaatgctgtcatggaggcaattgaggggatgagggtcgcactaggtgcggctgtgattttaaattattgcctgcaaggtctcttccatccagcaaggaaagtacgagaagtgtattggaagatatacaactctttgtacatcggcgcgcaggatgcacttgttgcttcttatcctgccctggaagacgatggggataacatctttagtcgtccagagttggcaatgtttgtctgattaacgctggatgtgcatgtccatgtgtcttcatccatattcttatgaagcttgaactggggtacctcatgttgcagctgctgaagcgttacactggatttaggaccaatcctaaggctgcagcatgccaattaatccatcaagatcctatattgtgaaggacaaatgacaatcctagcgcgctgtcatctttttatgaatattaggcgttgggcatttaccgtgttttaaaactttgtattacacatggatgttgtattatgtggtgtggacaatggaacgttgcaagctgacctgaacctgattccttactgtattactgagatgttgatatgcatgtcatgttagtgta

SEQ ID NO: 19 - DNA, 2997 bp, Zea Mays
taacaacatccaaaaatatgataacatatcaaaataattgattggcaaataatgctgaaactcatcaatacggttattctggtctagtaacaagcaaacataaatgagagcattttctcacagatagcctttcagcagttaccgcgaactagaaacatcaagatatcaaacactgcttcaacagaagatattccagcacaaacaataacaagcacagaaactattaagaatctaatcgacagagctagtacactagatcgtatagcttgtttgcttcagtgatgatccaggaaaatggaatgaatcacgttgtatatcatgaggatatcttgcaaatgtcctcgtattcgacagccctgagaaccttcccatcatagaggcctttctcaacctgcacttttgcacagaatttctcagtgtccactgaaagcaacctggcatttgacccccgataagccccattgacaatccgcacaagtccaccaatctgagggatcacggtctcaagctcatcttggtcgaccctgagaacatgcttgctctccaacatctcaatctccccaacatatttatcaataactttcttcaccacccctttctgcttgtagtaccccttctctgccaatgacttgctcatcactttgaccacaatcccagggcacagccagtagtccttcctattgctcctctccttggccttctcctcctccttcatcagctcgtccaatgctgacctctttgcctctgctgccttcacatcctttcccatcttcttggtcaactcattcttctcctggtctcgggtgcctgagccatcctcctcatcaaaaccaaatttcatcttcggcttatcgtcaaaaggattaaccttgggccccggcacagccttctgaagcgcaatcgcaatcttacctgttgccttatctgcctctttcgagtcatcctccggctcctgctcatcatcatccgaacctgaatactctccttcactgccagactcaggctcgccctcggcagcaccaccaccattgggtttagctaaggacttgtgcgcacgctcaatctggcgggcaatcatgcgctcctggcgctcgtcgtcagccatgtctgacttgatcctcttgcgcttgaggcgttccttgacggcctgctccgagtcacggtcgatgtaggtcatgaaccaccccttgggcgtgtcctcgaccttacagtacccctcgcgccccaggaacttgacgaactcggtgagcgtggcccaccgcgtggagttcatgtggacgtggtgccggtcggcgatgtactcgttgtagacgacggtggcggcgacgcgggagtggcggtgcgcgcggcggatgagggagaggaaggactcgaggaactcctcggagaagccctcgacgacgcggtcgggggccatgccgaacacctgcatctgcctctggtgcgactccgacatgcagtggcacttgaacccgttctcgtcgcggcactgcttctgacacatctgacagtaccaccgcagcttctgcagccccttcgccttgatccggtttgcgatcgccttcggcgtcaggaactcgtgcttccccatcgtgcgggagaggcccttgccgcacaagcaggatgggaattacaggtagaagaaggggggagcacgttggtcaaggagacggacgcgaggcgacgaggagtggattattattgtggagagaggcagcggcggaggccggagaggaggccggcgacggcgagattggggagtgcgtgaacggattggggatcgattggattggggcgagggctttgtttttttttgttgctttttttgtttttttattagacaggcgagggctttgttgggacttgggaataagtccaaggctagcaccacaaatgaacgatccggatcgcgtaaacgatcaatcaacggacgagatccagccaccgtgccagatttttcaacccaacgcatgtgaagggcgcgcatcgtatcttatcttcactctccgtccaccaaagcaaaccctacccgctcccttcccgcgccgccgccgccatggactcgatcgacgcagatctcgcgcgcacgcaagaggagcggcgcaggatggaggaggcgctggcggctggcgcgcccatggccgtgtcctccgtcaccttcgacaccgacctctacggcggcgggggcgccgaccccaaccgcttcgcgggctacgacacctccatcccggcctccgaggacgacgccgcggaggacgacgcggaggccgccaaccctgcgccgcgccgcctcgcggcctacacgggccacgccatcgccgccgccgacatcccgcggtcggccgacgacgacgacgggctgcccaagaggtcccagcgcatcatcgaccgcgaggacgactaccgccgccgccgcctcaaccagatcatctcgccggagcgccatgacccgttcgccgctggggaggccaccccggacccctcggtgcggacctacgctgacgtcatgcgcgacgcggcgctgcagaagaagaaggaggacctgctgagggagattgccaagaagaagaaggaagaggaagagaaggagaaggagaggaaggctgccgctcctgagcagcctgccgccacaacaaagcggcgcaacaggtgggatcagtcgcaggacggcgacgctggtgccggtgccaagaagggtacctcatgttgcagctgctgaagcgttacactggatttaggaccaatcctaaggctgcagcatgccaattaatccatcaagatcctatattgtgaaggacaaatgacaatcctagcgcgctgtcatctttttatgaatattaggcgttgggcatttaccgtgttttaaaactttgtattacacatggatgttgtattatgtggtgtggacaatggaacgttgcaagctgacctgaacctgattccttactgtattactgagatgttgatatgcatgtcatgttagtgtacgttgtgttc

SEQ ID NO: 20 - DNA, 6280 bp, Zea Mays
taacaacatccaaaaatatgataacatatcaaaataattgattggcaaataatgctgaaactcatcaatacggttattctggtctagtaacaagcaaacataaatgagagcattttctcacagatagcctttcagcagttaccgcgaactagaaacatcaagatatcaaacactgcttcaacagaagatattccagcacaaacaataacaagcacagaaactattaagaatctaatcgacagagctagtacactagatcgtatagcttgtttgcttcagtgatgatccaggaaaatggaatgaatcacgttgtatatcatgaggatatcttgcaaatgtcctcgtattcgacagccctgagaaccttcccatcatagaggcctttctcaacctgcacttttgcacagaatttctcagtgtccactgaaagcaacctggcatttgacccccgataagccccattgacaatccgcacaagtccaccaatctgagggatcacggtctcaagctcatcttggtcgaccctgagaacatgcttgctctccaacatctcaatctccccaacatatttatcaataactttcttcaccacccctttctgcttgtagtaccccttctctgccaatgacttgctcatcactttgaccacaatcccagggcacagccagtagtccttcctattgctcctctccttggccttctcctcctccttcatcagctcgtccaatgctgacctctttgcctctgctgccttcacatcctttcccatcttcttggtcaactcattcttctcctggtctcgggtgcctgagccatcctcctcatcaaaaccaaatttcatcttcggcttatcgtcaaaaggattaaccttgggccccggcacagccttctgaagcgcaatcgcaatcttacctgttgccttatctgcctctttcgagtcatcctccggctcctgctcatcatcatccgaacctgaatactctccttcactgccagactcaggctcgccctcggcagcaccaccaccattgggtttagctaaggacttgtgcgcacgctcaatctggcgggcaatcatgcgctcctggcgctcgtcgtcagccatgtctgacttgatcctcttgcgcttgaggcgttccttgacggcctgctccgagtcacggtcgatgtaggtcatgaaccaccccttgggcgtgtcctcgaccttacagtacccctcgcgccccaggaacttgacgaactcggtgagcgtggcccaccgcgtggagttcatgtggacgtggtgccggtcggcgatgtactcgttgtagacgacggtggcggcgacgcgggagtggcggtgcgcgcggcggatgagggagaggaaggactcgaggaactcctcggagaagccctcgacgacgcggtcgggggccatgccgaacacctgcatctgcctctggtgcgactccgacatgcagtggcacttgaacccgttctcgtcgcggcactgcttctgacacatctgacagtaccaccgcagcttctgcagccccttcgccttgatccggtttgcgatcgccttcggcgtcaggaactcgtgcttccccatcgtgcgggagaggcccttgccgcacaagcaggatgggaattacaggtagaagaaggggggagcacgttggtcaaggagacggacgcgaggcgacgaggagtggattattattgtggagagaggcagcggcggaggccggagaggaggccggcgacggcgagattggggagtgcgtgaacggattggggatcgattggattggggcgagggctttgtttttttttgttgctttttttgtttttttattagacaggcgagggctttgttgggacttgggaataagtccaaggctagcaccacaaatgaacgatccggatcgcgtaaacgatcaatcaacggacgagatccagccaccgtgccagatttttcaacccaacgcatgtgaagggcgcgcatcgtatcttatcttcactctccgtccaccaaagcaaaccctacccgctcccttcccgcgccgccgccgccatggactcgatcgacgcagatctcgcgcgcacgcaagaggagcggcgcaggatggaggaggcgctggcggctggcgcgcccatggccgtgtcctccgtcaccttcgacaccgacctctacggcggcgggggcgccgaccccaaccgcttcgcgggctacgacacctccatcccggcctccgaggacgacgccgcggaggacgacgcggaggccgccaaccctgcgccgcgccgcctcgcggcctacacgggccacgccatcgccgccgccgacatcccgcggtcggccgacgacgacgacgggctgcccaagaggtcccagcgcatcatcgaccgcgaggacgactaccgccgccgccgcctcaaccagatcatctcgccggagcgccatgacccgttcgccgctggggaggccaccccggacccctcggtgcggacctacgctgacgtcatgcgcgacgcggcgctgcagaagaagaaggaggacctgctgagggagattgccaagaagaagaaggaagaggaagagaaggagaaggagaggaaggctgccgctcctgagcagcctgccgccacaacaaagcggcgcaacaggtgggatcagtcgcaggacggcgacgctggtgccggtgccaagaaggtgaagacatcctcggactgggatgcccctgatgcgactcctgggattggccgttgggatgccacccccggacgtgttggagacgccacaccctccgtgagaaggaacagatgggatgagacaccgactccagggaggatggccgatgctgatgctacgcctgcagctggcggtgccacccctggggctactccttctggggcttgggacgcgactccaaagctgcctggtggtgtcacgccaacccctggtaagaagcagagatcaaggtgggatgagacaccagcaagtatggggagtgcaacccctggtagtcttggtgctgcaacacctgctggttatactcctggtccaacgccatttggtgcagagaaccttgccacaccaactcctagccagattgctcgtggaccgatcactccggagcagtaccagctcatgcggtgggagcgggacattgaggagaggaacaggcctctcactgacgaggagcttgatgccatgttcccgcaggagggctacaagattcttgagcccccggcttcctaccagcccatcaggaccccggcaaggaagctccttgcgacaccgacacctctggggacaccactttatgctattccagaggagaatcgtgggcagcattttgatgtgcccaaggagctgcctggtgggttgccactcatgaagcccgaggattaccagtactttggaactttgctgaacgaggaagaggaggagcagctatcgccagaggagcagaaggagaggaaaatcatgaaactgttactcaaagtgaagaatggcacacccccacagcgtaaaacagcacttcggcaactgacagacaaagcccgtgaatttggtgcaggaccgttgttcaacaaaatactgcccttactcatgcagccaacactggaggaccaggagaggcatcttttggtgaaggtcattgacagagtactttataagctcgatgagctggtccgtccttttgtgcacaagattcttgtggttattgaaccactgttgattgatgaggactattatgctcgtgttgaaggcagggagatcatctcaaaccttagcaaagcagctgggcttgctactatgattgctgctatgcgacccgacatcgataacattgatgagtatgtgagaaacaccactgctagggcgttcagtgtggtggcttctgctttgggtatccctgcccttttaccattcttgaaggctgtctgtcagagtaagaagtcttggcaggctaggcacactggtatcaaaatcgtccaacagattgctattctcatgggctgtgctgttttgccacacctcaagtcactagttgagatcattgagcatgggctgagcgatgaaaaccagaaagttcgtacaattactgccctttctcttgctgcacttgctgaggctgctgcaccatatggtatagaaagttttgatactgtattgaaacctctgtggaagggtatcagatctcaccgtgggaaggtccttgctgccttcctaaaggccattggtttcatcatccctcttatggatgctctgtatgctagctactacacaaaggaggtgatgcaggtcctcattagggagttccagtctccagatgaagaaatgaagaaaattgttctcaaggtggtgaaacagtgtgtcagtacagagggtgtggaggctgattatatccggaatgacatccttccagatttcttcaagcacttctgggtgaggagaatggctctagatcgcaggaactataagcagcttgtggaaactacagttgagatggcaaacaaggttggagttgctgatattgttgggagggttgttgaggatctgaaagatgaaagtgagccctacagaagaatggtgatggaaacaatcgagaaggtggtagccaacttgggtgcatcagatattgatgctcgtctggaggagctgcttattgatggtatcttgtatgctttccaagagcagactagtgatgacgcaaatgttatgctaaatggttttggagctgtggttaatgcacttggacagagagttaagccctaccttcctcagatttgtggtactatcaagtggcgattgaacaacaagagtgcaaaagttaggcagcaagctgctgatctgatctccaggatagccatagtaatgaagcagtgccaggaggagcagcttatgggtcacttgggtgttgtgctgtatgagtacttaggagaggagtatcctgaggtgcttggttcaattcttggagccttgaaggctatcgtcaatgtcattggtatgactaaaatgactccaccaatcaaggatcttcttcctcgtctgacccccattcttaagaacaggcatgagaaggtccaagagaactgcattgatcttgttggtaggattgctgatcgtggagcagaatttgtgccagcaagggaatggatgaggatttgttttgagctgctcgaaatgttgaaggctcataagaagggtattaggagagcaactgtgaacacatttggttatatcgcaaaggctatagggccacaggatgtgttggccaccctgttgaataacttgaaggtgcaagaacgacagaaccgggtctgtacaactgtagctattgctatagttgctgaaacttgctcacctttcacagttttacctgcccttatgaatgagtaccgggtcccagagctcaatgtccaaaatggtgttctgaagtcactctctttcctctttgagtatattggtgagatgggcaaagattacatatatgccgtcacccccttacttgaagatgctttaatggatagagatctggttcaccggcagactgctgcatctgctgttaagcacatggctctaggtgttgctggcttgggttgtgaggatgctcttgttcatctgcttaactatgtttggcccaacatatttgagacatctccccacgttataaatgctgtcatggaggcaattgaggggatgagggtcgcactaggtgcggctgtgattttaaattattgcctgcaaggtctcttccatccagcaaggaaagtacgagaagtgtattggaagatatacaactctttgtacatcggcgcgcaggatgcacttgttgcttcttatcctgccctggaagacgatggggataacatctttagtcgtccagagttggcaatgtttgtctgattaacggtacctcatgttgcagctgctgaagcgttacactggatttaggaccaatcctaaggctgcagcatgccaattaatccatcaagatcctatattgtgaaggacaaatgacaatcctagcgcgctgtcatctttttatgaatattaggcgttgggcatttaccgtgttttaaaactttgtattacacatggatgttgtattatgtggtgtggacaatggaacgttgcaagctgacctgaacctgattccttactgtattactgagatgttgatatgcatgtcatgttagtgtacgttgtgttctccttgtcattttgtttgtgatatcgacatgctatgtttgttgctgaagttgagcacaaatgatttgttggtca

SEQ ID NO: 21 - DNA, 1275 bp, Zea Mays
atggggaagcacgagttcctgacgccgaaggcgatcgcaaaccggatcaaggcgaaggggctgcagaagctgcggtggtactgtcagatgtgtcagaagcagtgccgcgacgagaacgggttcaagtgccactgcatgtcggagtcgcaccagaggcagatgcaggtgttcggcatggcccccgaccgcgtcgtcgagggcttctccgaggagttcctcgagtccttcctctccctcatccgccgcgcgcaccgccactcccgcgtcgccgccaccgtcgtctacaacgagtacatcgccgaccggcaccacgtccacatgaactccacgcggtgggccacgctcaccgagttcgtcaagttcctggggcgcgaggggtactgtaaggtcgaggacacgcccaaggggtggttcatgacctacatcgaccgtgactcggagcaggccgtcaaggaacgcctcaagcgcaagaggatcaagtcagacatggctgacgacgagcgccaggagcgcatgattgcccgccagattgagcgtgcgcacaagtccttagctaaacccaatggtggtggtgctgccgagggcgagcctgagtctggcagtgaaggagagtattcaggttcggatgatgatgagcaggagccggaggatgactcgaaagaggcagataaggcaacaggtaagattgcgattgcgcttcagaaggctgtgccggggcccaaggttaatccttttgacgataagccgaagatgaaatttggttttgatgaggaggatggctcaggcacccgagaccaggagaagaatgagttgaccaagaagatgggaaaggatgtgaaggcagcagaggcaaagaggtcagcattggacgagctgatgaaggaggaggagaaggccaaggagaggagcaataggaaggactactggctgtgccctgggattgtggtcaaagtgatgagcaagtcattggcagagaaggggtactacaagcagaaaggggtggtgaagaaagttattgataaatatgttggggagattgagatgttggagagcaagcatgttctcagggtcgaccaagatgagcttgagaccgtgatccctcagattggtggacttgtgcggattgtcaatggggcttatcgggggtcaaatgccaggttgctttcagtggacactgagaaattctgtgcaaaagtgcaggttgagaaaggcctctatgatgggaaggttctcagggctgtcgaatacgaggacatttgcaagatatcctcatga

SEQ ID NO: 22 - DNA, 2141 bp, Zea Mays
cggtccaaccaatggccgggttcgcgcgcgccaccgcccccgcgtccccgtcaccggcggcggcgctgctcaccggcgagcgcctcgtggtcttcctcttcgcggcccgcgtggcactcgcggccccggtgcacctcgccgcggcgctcgcggtcctcgtggcggccgccctcgccgtcgagctcgccgtggacggctccggctccgccccgcttcgccgcttcaggaccaggccaggtgcttcgtcaggcatacttcttggcgccactactctgcccagcgtcatgctttctcggttaattcaactgtcaaggctcctaccagctgatcctaatggacctaaagaatttgcatacctggaaatgcagtactgggcagcatcaatcagctgtctcagtgtgctagctttattcctttggcatctacagaagtctcccagcaatgggatctctaaacatttggagtacggctcattgtttatagttttatatctcatgacattctttttgtcctttctactgaagactgatgaaggcttgatggtaacgaccaatatggcgtatatgctctgtcatggagtggctgctgtgatcttaatcaagcatatcctagagaagtttccctcatgcgcatcttttggggaggcgcttttggtgtcaggtggtcttgttctctactttggtgatatgttggcacatacactttcaaagatggagttctccatgtcatcaaaagcattcattcacacacctcaaactagaagcgatatgaccgcaattattcaggggattttacttgtcctttttctacttccgttactatacaagagttctcttaaagtttggtattgctggacaaaggagagaaagcaacaaacacaaacacctgaggaacataagcgaataagaattgattctgccatattctatatctcgttggcggtggtgttaatatttttactgccatcatggacacaccttgtccaaggcctcaaagtgcatccttttgtttggattgttaactatatgttcactgattcacatgagcgacttgttttatgtgcatactggatatgtgtaatatatgtatcagttagaaggttctacagtatatcaaagcaaagcaagacagagaggattcttttgcgcaagtattatcatcttgtcgctgttctcattttctctcctgcagttatatttcagcctgctttcttggacttggcatttggtgcagcatttgcagttttcttgatattggagatgttacgaatttgggaaatataccctcttggacgtgttgtgcatcagtttatgaacgcctttactgatcatcgtgattctgagattcttattgtcagccatttttcactcttactgggctgtgcacttccgaaatggatgtcatctggattaaatgaccgaccacttgccccttttgccggaattctcagcttggggataggtgataccatggcatcaatgatagggtacaagtatggcgtgttaagatggagcaagacaggaaagaaaacaatcgagggcacggcagcgggcataacatcggtgctagcagcctgctcgatcctggtgtcactcttggcttccagtgggtacattctttcgcagaattggctatcgctcctgatagctgtcacattgagcgggttattggaggcatacactgcacagctggacaatgccttcatccccctcgtgttctatagtcttctgtgtctataagggtagcatcctgtacatctaactgaccttgatatcctctttttgtttacacgctattagtatatacgtagtgcaatatgttatttcgacattactcacttggtctcctcggcgcatcaactgcctggtgattcagttcaacagatcacattctgtgtaaccctgcctttcggaagttgagaggacgtgctcatggttgagacagtcggtacaggcatatgaccagaagtagaaaaataaaatgttctccagtcgttcagtagagggtgtttttggcggagctgggcagttggatgctgtacataaagttttttttatatgaacctgttgactgttgttgggacgaacagtattgaaacatgctgtgatgctgatcaatttgatcactctatttgctctttc

SEQ ID NO: 23 - DNA, 1307 bp, Zea Mays
actcaaaaggagtgcctccaaaaggaaacgcgcaacaggagaccgggagagcgagcgaccaatcggactaccggccggagggtcggagggagctagcatgagagcgtccattccaacccaccaccaccatcgctgttcattcatccgttacgcacacaagtagtataaaacaaaaccctgtgctcaccagtccttccctccctccctgcctgctgtccgatcccgttccattgctcaccctccattggtgtggtgtctgtcttttcgtgcaatcaaaggcgatccgcaaacaaacacacggccagagatcaagcagccagctagcgcagcgcgagtggttccaatgcagggagacccggggtacggtggctacggctacgggtacggctatgacgtcgccggcaacggcggcggaggcgggtactaccctgcgaacgaccggtaccctgccgctgcctatgaggacccgctcgcgggtcggaggcagccgctgctcacggggctggagttcgaaccgtcggacacctgccccaggaactacgtcatcttcgaccagacgtacgaccggagccgggtgatgtaccacccctctctgcccgccgacaacttcgaccaccagggttactactccggtgagagcgcctaccacggcggcggcggcagcggtggctcggtccggcagaaggaggacaccgacgagatcgacgcgctgatgagcacggaggacggcggcggcgacgacgacgaggacgacgtgctcagcacgggccgcacgccggggtgccgcgccgctggctccccggactccacgtgctcgtccggcggcggccggaagcacgaggcgccggccggcggcgagaagaagaaggaacgggtgaagaagatggtgcggacgctcaaggggatcatccccggtggcgaccggatggacacgcccgcggccgtcctcgacgaggccgtcaggtacctcaagtcgctcaaggtggaggtcaacaaggccgatgcgcgtgggtccggcagctagctagctagccggcttccaactgctagtctggctttgccgatcaaaacaggagtatctatctctctgcgcatcggcagagaagatgggacacgtacgcgaacaaagaagatggtcaacggtgctggagagacagaggcagtaatggattggaatctaagtgcaaaaatagagagagttctatcactccctccgttcatgtttacacaggcctacgccaatttttgatttggccgagtagatatcaagggccaattaattactcgggagaaagaaaaaaaaaaaa

SEQ ID NO: 24 - DNA, 1137 bp, Zea Mays
atggatgatcaggtttacatgcaacctgaagacaacagaatgcggagactatctgaagacactcttttatgtgacagtgaagaatctttaaccaaaagaaaactcgatttttctcagcctattggtggtgacaacagcacagctacacttattccttacccaactattaccggaaacgaggattttgttccatcgtcttctgatgttgcacaagtaggagatggtgatgatgatgtgaccaatttttgcttgacaagacgagagccaccaacttgtgacgttgcacaagtaggagatggtgatgatgatgtgaccaatttttgtttgataagacgagagccaccaacttcaccttttattgattcttgtgtcgacacaacagagttagctgaggattattcaagcttcccctgcgccctaccctctgttgttaactttagtgacattgattcttttcttgatggttgcgatcaattgttcgaaaaccaaactttggatataatttctcctgttgagatacaccctagcatggacaccgttgcaacactagaagatcttttcctcaagacaaccagacaagcattggcaaatgttcttgatgggctaaatgcccatactttgagagatcctgttcgttgcgccagtctgcgcctcgcttcgtcttgtcttacaggacaatttgctagcattgcaagaattaaagctatgctggacaaattaattaccatttccgaacagctgcagaggacgtattctaactttgaagtggcaagaaaacaagacgaacaaagtactgctaaaatcaagcaggcgcttgacgttcaaagggaagctcttcgcactgttgatgacgaattggcctctgctgaaaagcagcgggcagaaaccatgacgacaattgagaaacttaatcaaattttaatggaggtagagcaaaagagagcgcgacttgaggaaatgcgttctacttcagatttggaggtgaggaaattagagcaggacttgtgtgatgcaattgcagacgcgagcaagaaggctattgatgtttttcagaaggaaacaacggaactaaatcagcaggctgagcaacttcttattgatttaaatagctgtcgatgtcgatctagtagtaactag

SEQ ID NO: 25 - DNA, 744 bp, Zea Mays
atggctggacgcgttcaagacttcatcacgctccgcatcggttcgctttggctggatgtgccactgggacctctccatgctagcgatagtgctggctccctgcgtaccacagctgcatcaccagccatgattgggcttgagcaggaggtcaactccaaacctcatgatggtttcattccagttgtgtctaaagctgcaaagcgaagggcaaggaggatggctgcgaggtcaagagcatcagcctcccaagaacaccctaacaaggtgcacaaggttgcgttctccagctcaggtcctcctggtttctccaagccgaaggtcaataaatctgttgaccacaaggcagaagcaaagtttcgtcaaactacccttggggagtggcctgtctgcatcaagcaagcacctccaaccaagtttgtacagtcaagggcttcctctacatcaactccaaaagagacaactcctactttgacacctcccaatatgctgggggtgcggtcatcaaaacttgttccaagcatacttggggcaccaccaaccaaaatagtgacaacaacaaatccaattagtccaaatgaagaggtggtattggtagatcaacatcaacatccacagccctgtaataagggaaaggccgccatggtggaaaaggaggttcttcaaccgtccatggacaaagggaaagaagtggtgatggaatataatacatcatcctctaaaaatgagtcacatactagaccttag

SEQ ID NO: 26 - DNA, 2007 bp, Zea Mays
atgacggatcatgcgcgtgaaaatgggtgcaagccgcctgacccatcgttggagaatcaattagcatttcttcggtgcaagggttctcagcagagaactggctacatgaaaggatgggagaattatgatattgagtatattcctattccttctggttatgcggaatggggtacaataattcttgcaaaacattcttttaatttaagaggagatggagaagtggatggggaattttatgaggagtatgtcccgtcacatcatgagcgtgaaccatccatgttattatatcccaagtgcttatcacaacttttggaggtttgggatgaattacaagtggggggagaagtatcgctgcaagaatggcgtgataacatatgcattgcggagccgtaccatccagatcgtgtaactcgacagtttaggcttgatcaggtcgtcccatatcttgtactgaagagcgtgtatacagaagatgattttggggtcgcttactcttactgggcacatcttttacgcccaataaatcaggatttcagttgtctccctaatgagactcgtattggcagctgcacaatatattggataaattggtatagaaaattttcagagccttttatctcggtattgacgaacttgcgctgtggttgtgcacgtggtcgtgtacattataatgatagaaaaagactagcagcaggcaagattattcctcgtcgtctttctccatctgattttgtggtgatacgagaagtgcgtgaggagcagcatactaagtatattgcatttatcaaggctagagaggagcactctgagataaatcttatggagggttcttctttgcaacacgtacctaccgataatacatcacagaaagactccatggatgatcaggtttacatgcaacctgaagaaaacagaatgtggagactatctgaagacactcttttatgtgatagtgaagaatctttaaccaaaagaaaactcgatttttctcagcctattggtggtgacaacagcacagctacacttattccttacccaactattaccggaaacgaggattttgttccatcgtcttctgacgttgcacaagtaggagatggtgatgatgatgtgaccaatttttgcttgacaagacgagagccaccaacttgtgacgttgcacaagtaggagatggtgatgatgatgtgaccaatttttgtttgataagacgagagccaccaacttcaccttttattgattcttgtgtcgacacaacagagttagctgaggattattcaagcttcccctgcgccctaccctctgctgttaactttagtgacattgattcttttcttgatggttgcgatcaattgttcgaaaaccaaactttggatataatttctcctgttgagatacgccctagcatggacaccgttgcaacactagaagatcttttcctcaagacaaccagacaagcattggcaaatgttcttgatgggctaaatgcccatactttgagagatcctgttcgttgcgccagtctgcgcctcgcttcgtcttgtcttacaggacaatttgctagcattgcaagaattaaagctatgctggacaaattaattaccatttccgaacagctgaagaggacgttttttaactttgaagtggcaagaaaacaagacgaacaaagcactgctaaaatcaagcaggcgcttgacgttcaaagggaagctcttcacactgttgatgaggaattggcctctgctgaaaagcagcgggcagaaaccatgatgacaattgagaaacttaatcaaattttaatggaggtagagcaaaagagagtgcgacttgaggaaatgcgttctacttcagatttggaggtgaggaaattagagcaggacttgtgtgatgcaattggagacgcgagcaagaaggctattgatgtttttcagaaggaaacaacaaaactaaatcagcaggctgagcaacttcttattgatttaaatagctatcgatctagtagtaactag

SEQ ID NO: 27 - DNA, 667 bp, Zea Mays
gcactgcggcagtactgcaataccaagttaccaacttatcacagttatcagaactgaggcatattacctatccacgaggagcagaaagcatatttgccaatgtatgctggggttggtatgcagccattgcaatctctgtatctctagttccttccatggatctctggttgatgttagcggatccaattatcacatattcatcatccacaatcatgcctttcgagtgcacatacaccatgaatctcctattattccgagcttggtcctgattggatatccaagctgcagcataattgtatttttctggggaaatcagtacctccttcagttttgggcatttctaaagtgtaccggaatcagcagcagaaaacagaacaatagtatgcagtctaacctgtgggttactggttgagaatggtccactagatgtgcaagtagtgtcctcggcttcacggttaccaaggcagaagaaattcagtgatttatggagccctttggtagacttacctgcatgtcccatctctctggatcatcgtcatttgaatagatttcgtcgtcaatagaaataatatcagtttttcaggacatcgtatgcttctggaccgtcgatcttggaatgcaagtcatgccatggctctcttgggccgcgagcatcttcaacctgaga

SEQ ID NO: 28 - DNA, 1309 bp, Zea Mays
acgcttctctctccctcatccgcctgggatttttttttcagccgtgcgccctggagctcccacggtcgcgccctgctcggctctcacgccgtcgatttggagctccggcgcgagctcctttgctggccgctgcagctcgccttctttggtgcgtgcgcccctggtctcggccccagctcggcctctgctcctcccatccatggctctccagctcgcccgaccgcgacctcgccttgctgctacgctcgcccagcccctctctctggcgagcttgaccggcgtcgagctctagcggtcctcctccgctgccactcgttggaccttgcccctgctgcgccgtcggcagctccccacaccctctcctcctcaagcttgttcccatggtgccccagcccccaacgccgagctcggtcctgccctctgccatgacgcctggccgccgctgctccatctcagatcgcactcgcccagctctgttggccgcacccctatcccttatcccagctccctcgctggcgtcgatttgcttgcaggtggctgtgagttcttcggttcttccctgtgcgcacgcgagctcctttgcttggcccgttgtcgttcttaccgcgctcggctgttcgtcgtcgtcacccgatcgcgcaacgagctgatagccccggcattcgtcctttgtccgtgtcatgtgccccacgacctatgtccttgccgtcgcgtcgagcccgtcaaaccccgtcctctcctactcgacctcgtctttgcccttctgggggtcgccgtcgtgtctgggattttagcatgtctccctgctcgccgttgaacctgggttccctgctcagccttcatagctagcgcgtcgtctttcgtctgtggtcgagcgtctgctccatcccagcaccctgcattagtgctcgacaaaaagcccaaacgaatcgtcatgccatcgtcttcgtcgaatggaaatcgtcgtgctgacacgccgatgtcgtcgatcgccatcctcgtctatgccaactctgtgtagctcgttaccacaccctgtagtcgcttccatgacgttgtcgtggggacttctgtgcgtcacatgtgcttcggtcacactaaatcaccctgcttccatttgtgtcgacagcaagccgtgaagacgctcttgtgctagccacgcgccacctgctcgacaaaacggatcccctgagtatctggtcaagaaatgagattgtgtgcatcgcttgccaggtgtgtgcggtcaaaggcgtcaagcaataaccatcgttgttcttccgactattgtgttggattggtcagggtaagc

SEQ ID NO: 29 - DNA, 781 bp, Zea Mays
atggcgatcgacgacatcggcgtgtcagcacgacgatttccattcgacgaagacgatggcatgacgattcgtttgggctttttgtcgagcactaatgcagggtgctgggatggagcagacgctcgaccacagacgaaagacgacgcgctagctatgaaggctgagcagggaacccagccgagcgcggtaagaacgacaacgggccaagcaaaggagctcgcgtgcgcacagggaagaaccgaagaactcacagccacctgcaagcaaatcgacgccagcgagggagctgggataagggataggggtgcggccaacagagctgggcgagtgcgatctgagatggagcagcggcggccaggcgtcatggcagagggcaggaccgagctcggcgttgggggctggggcaccatgggaacaagcttgaggaggagagggtgtggggagctgccgacggcgcagcaggggcaaggtccaacgagtggcagcggaggaggaccgctagagctcgacgccggtcaagctcgccagagagaggggctgggcgagcgtagcagcaaggcgaggtcgcggtcgggcgagctggagagccatggatgggaggagcagaggccgagctggggccgagaccaggggcgcacgcaccaaagaaggcgagctgcagcggccagcaaaggagctcgcgccggagctccaaatcgacggcgtgagagccgagcagggcgcgaccgtgggagctccagggcgcacggctgaaaaaaaaatcccaggcggatgagggaga

SEQ ID NO: 30 - DNA, 565 bp, Zea Mays
gtttgtaccttactagttcatccaaatttctccctgcccctgatgatagtttagcacttgacatagcgtataccatctatatgaagtttggagaccttgcaagtgctttgagaatttctctgcaacttgagaaatctgtgcagtatgtgaagcaagtctacacagcaactgatgatcttctgctgaagaaacagttctcttatctcattgcgcgccatggtttggctatggagattgatgacgagatctctactgatgataatgataaggaggctttacaagaaatagtaaataatactaagttgagtgagggatatcttactcttgctcgcgatattgaggtcatggagcctaaatccccagaggatatatacaaggtccatttgattgatggccgtggtgccagctccagtcttgattccgcaagacagaatttagctgcaacatttgtaaatgcatttgtgaatgctgggtttggcaaggacaagttgatgaccgctccatctgattcacccagcagcgggtcttccggaaattggttatttaagaacaaggaacatggaaa

SEQ ID NO: 31 - DNA, 1909 bp, Zea Mays
tacttgcatagtaatgatactcatgttgtagctggagccttgctaggtattggaattgtcacttgcggggtgaagagtgattgtgatcctgcgtttgctattctcatggagtatattggcaaagatgactcaaacattcgtattggagcaatattgggtcttggaattgcatatgctggttcccagaaagaagagcttaaaatgcatctatctgctgtgctgggagactctcaatcacctcttgaagtattggtcttctcagccattgccttggggttggtgtttgttggttcttgcaatgaagagattgcacagtctattatatttgccttgatggagcgtagtgaggctgagttggcagagcccattatacggttgcttcctgttgcgcttggccttctataccttggaaaacaggatagtgtggaggctaccgcagaggtctctaaaacatttgatgaaaagatagggaagtactgtgatgtaacacttatgtcgctggcatatgccgggacaggaaatgtgcttaaggttcagaaacttcttggcatttgttcacagcatcttgagaaaggtgaaacacaccaagggccagctgtccttggaattgctcttattgctatggctgaagaattaggagctgaaatggctgtacgttcacttgagcgtcttctgcagtatggcgagcagaatataagacgagcagttcctcttgctcttggtatactctgcatatctaatcccaaggtgaatgttatggacacactgagtagattgagtcatgatgccgatgccgatgtgtcaatggctgcaattatctcattgggtttgattggtgctggcacaaacaatgccagaatagctgccatgcttcgcaatctttcaagttattactacaaagaagcagctcatctgttttgtgttagaattgctcagggccttgttcacctcggaaagggcttgttgaccctttctccgtaccattctgatagatttcttctttccccgatggcacttggagggcttgtaactgttctgcatgcgtgtcttgatatgaagtccactatcctagggaaatatcactacatactttacattattgtcctggcaatgcagcccaggatgcttttaactgtcgatgaggatctgaagcccctctcagtacctgtccgcgttgggcaagctgtggacgtggttggtcaggcaggaaggcctaagacaattaccggctttcagacacactccacaccagtcttgcttgcagcaggggagagagctgaactagcaactgaaaaatacatcccactgactccggtattagagggctttgtgattttgaagaagaacccggagtaccatgaagagtgaaacgctttagcatgccaaatagcatggtgtttcggaggctcgtgcacatggcagtcttcaagccctggcgcacccctcgtcgagaaatcgctcgccctttgctcaacccttcgcctggagttcatgttgaattcttaccagagttgtggctaactgaaagctgtcttcggttgtgctgatatacgattgtatctgtacgattgtagcaattactgggacagcttactctgtatggtgtggtgataacgtggcatagcatttttggcgctggtctaggttagtccttgtgttgacatggtgcaccatcattataagttttctgtattttatggatccgttctgttcgtgtgtactggaaacattgtacacatgatatgtaagtgtgcctccatgtgtatgtgtgccttcgtgtgtgttttggttttgtctttagcatggcttttgtccccttaaaaccaaaagacaaatcaaagcgctcgaagcaactttttccaaatatatatggaagaacttttagggctgatttggtgatgggtttttt

SEQ ID NO: 32 - DNA, 1696 bp, Zea Mays
cttcaaagcctgtatcatgctgcatcttccttccctggggccagcctcgtcaactccgcttccggttctggcccattggcgttgcttcacatcgacgcgcctgcgccgccggtccgccgcgccttcccctcccttctcccccgcgtgccctcctattccttctctgcggcggcgtggggagctgcatctgccttcgtctggaggagtgggaagaagcgctgccgaaggggtgatttacgaagccagagagcggctgggagcaagagtgcctgggactgggagttgaagctagagaggctagttgcttgtttggtgcgctgccaaaccgccctcaacatctgacccgtctctccctcacttccacggttccagcgagcggcgcaaccgcgcaactgagcagctagcatgggggacgaagaagatgatcctgactggctccgcgcgtttcagaggggtcaactatggatgaaaaacaagctaatactcctagacgcttgactccaaagaaggatatggtaacactttcatctggttctgatgcttcaccgggaaacagcctttcgagggcccatgaagataaccatgaagagggctcacttagcactgccaagagaaagaatgctcaacaaactaagactaaaaaaacaaaggatgctggaacaaaaactggtgcagaccaagcagggaatggagatgctgaggatgatgtgcaagataaactcacagggaactctgtaaagtgccaactcacccatctctccattttattctttttgctccttcaaatttggatgtgaaactctaggcctttagctattttcagttgtatatctgcagctctttgatggagtttatgctcctctaaatgccaggtctcccagaggttaccattaatatttccagataaagttcaacgttcaaaggcattgattgaatgtgatggtgactcgatagatttaagtggagatattggtgcggttgggaggatagtagtttcaaatggtcctactgcaaaacaggatttgttgttggacctgaaaggaacaatatacaaaacaactatagttccatccaggacattttgtgttgtgagtgtgggacaatcagaagcaaagatagaggctataatgaatgacttcattcaactggaaccacaatccaatttatttgaagcagagactatggtggaaggtacccttgatggattcacatttgattcagatgaggagggtgacaaactctatgaaccacaggctaatcaaaacgatctgaataataacgaagatgaaggtcaacctaaggcaaagaccaaaaggaaagcagagaaaacaacggggaaggcaccgaagaaggcgaaggttgcaggaaagggccctaaaaagggcacgaggaaaacccaacctgcgaagagaggtaggaaggctaagaaatgatgacatgttgatttcctcggataagaagaaaaagtctattgagaacctggatagctggcaacaaagatgtgaatttttcaacgcatagtcatggctgtgaggcgcgtcgtcagttcaacatcatgcagtacttgttttagagagagagaacatgtaaagctgtaaacgttgttgtgtactctatgagcgttcagctttggatcattgaaaagaccgagatgttcacgtggaggcgaactgacttctctattttttttcacaaa

SEQ ID NO: 33 - DNA, 1560 bp, Zea Mays
cttcaaagcctgtatcatgctgcatcttccttccctggggccagcctcgtcaactccgcttccggttctggcccattggcgttgcttcacatcgacgcgcctgcgccgccggtccgccgcgccttcccctcccttctcccccgcgtgccctcctattccttctctgcggcggcgtggggagctgcatctgccttcgtctggaggagtgggaagaagcgctgccgaaggggtgatttacgaagccagagagcggctgggagcaagagtgcctgggactgggagttgaagctagagaggctagttgcttgtttggtgcgctgccaaaccgccctcaacatctgacccgtctctccctcacttccacggttccagcgagcggcgcaaccgcgcaactgagcagctagcatgggggacgaagaagatgatcctgactggctccgcgcgtttcaggcaccaactgtggcacctgtgatgctttcttctggttcagatacctcccctgaagctagtcctacaagaaccagtacatctagaaaacaaaacaagggagagaagcacgctagtccagatcatgcacgtgatagagatggtgcttcacaaaataaaaacaaaatctcagcagctactagaagaaaaaaccttgtcagtaaaaaagaggggtcaactatggatgaaaaacaagctaatactcctagacgcttgactccaaagaaggatatggtaacactttcatctggttctgatgcttcaccgggaaacagcctttcgagggcccatgaagataaccatgaagagggctcacttagcactgccaagagaaagaatgctcaacaaactaagactaaaaaaacaaaggatgctggaacaaaaactggtgcagaccaagcagggaatggagatgctgaggatgatgtgcaagataaactcacagggaactctgtaaattgtatatctgcagctctttgatggagtttatgctcctctaaatgccaggtctcccagaggttaccattaatatttccagataaagttcaacgttcaaaggcattgattgaatgtgatggtgactcgatagatttaagtggagatattggtgcggttgggaggatagtagtttcaaatggtcctactgcaaaacaggatttgttgttggacctgaaaggggaaggcaccgaagaaggcgaaggttgcaggaaagggccctaaaaagggcacgaggaaaacccaacctgcgaagagaggtaggaaggctaagaaatgatgacatgttgatttcctcggataagaagaaaaagtctattgagaacctggatagctggcaacaaagatgtgaatttttcaacgcatagtcatggctgtgaggcgcgtcgtcagttcaacatcatgcagtacttgttttagagagagagaacatgtaaagctgtaaacgttgttgtgtactctatgagcgttcagctttggatcattgaaaagaccgagatgttcacgtggaggcgaactgacttctctattttttttcacaaattaaaatctatcagtaaggctttgttcgtttatgcc

SEQ ID NO: 34 - DNA, 1769 bp, Zea Mays
cttcaaagcctgtatcatgctgcatcttccttccctggggccagcctcgtcaactccgcttccggttctggcccattggcgttgcttcacatcgacgcgcctgcgccgccggtccgccgcgccttcccctcccttctcccccgcgtgccctcctattccttctctgcggcggcgtggggagctgcatctgccttcgtctggaggagtgggaagaagcgctgccgaaggggtgatttacgaagccagagagcggctgggagcaagagtgcctgggactgggagttgaagctagagaggctagttgcttgtttggtgcgctgccaaaccgccctcaacatctgacccgtctctccctcacttccacggttccagcgagcggcgcaaccgcgcaactgagcagctagcatgggggacgaagaagatgatcctgactggctccgcgcgtttcaggcaccaactgtggcacctgtgatgctttcttctggttcagatacctcccctgaagctagtcctacaagaaccagtacatctagaaaacaaaacaagggagagaagcacgctagtccagatcatgcacgtgatagagatggtgcttcacaaaataaaaacaaaatctcagcagctactagaagaaaaaaccttgtcagtaaaaaagaggggtcaactatggatgaaaaacaagctaatactcctagacgcttgactccaaagaaggatatggtaacactttcatctggttctgatgcttcaccgggaaacagcctttcgagggcccatgaagataaccatgaagagggctcacttagcactgccaagagaaagaatgctcaacaaactaagactaaaaaaacaaaggatgctggaacaaaaactggtgcagaccaagcagggaatggagatgctgaggatgatgtgcaagataaactcacagggaactctgtctcccagaggttaccattaatatttccagataaagttcaacgttcaaaggcattgattgaatgtgatggtgactcgatagatttaagtggagatattggtgcggttgggaggatagtagtttcaaatggtcctactgcaaaacaggatttgttgttggacctgaaaggaacaatatacaaaacaactatagttccatccaggacattttgtgttgtgagtgtgggacaatcagaagcaaagatagaggctataatgaatgacttcattcaactggaaccacaatccaatttatttgaagcagagactatggtggaagatgaggagggtgacaaactctatgaaccacaggctaatcaaaacgatctgaataataacgaagatgaaggtcaacctaaggcaaagaccaaaaggaaagcagagaaaacaacggggaaggcaccgaagaaggcgaaggttgcaggaaagggccctaaaaagggcacgaggaaaacccaacctgcgaagagaggtaggaaggctaagaaatgatgacatgttgatttcctcggataagaagaaaaagtctattgagaacctggatagctggcaacaaagatgtgaatttttcaacgcatagtcatggctgtgaggcgcgtcgtcagttcaacatcatgcagtacttgttttagagagagagaacatgtaaagctgtaaacgttgttgtgtactctatgagcgttcagctttggatcattgaaaagaccgagatgttcacgtggaggcgaactgacttctctattttttttcacaaattaaaatctatcagtaaggctttgttcgtttatgcc

SEQ ID NO: 35 - DNA, 1799 bp, Zea Mays
cttcaaagcctgtatcatgctgcatcttccttccctggggccagcctcgtcaactccgcttccggttctggcccattggcgttgcttcacatcgacgcgcctgcgccgccggtccgccgcgccttcccctcccttctcccccgcgtgccctcctattccttctctgcggcggcgtggggagctgcatctgccttcgtctggaggagtgggaagaagcgctgccgaaggggtgatttacgaagccagagagcggctgggagcaagagtgcctgggactgggagttgaagctagagaggctagttgcttgtttggtgcgctgccaaaccgccctcaacatctgacccgtctctccctcacttccacggttccagcgagcggcgcaaccgcgcaactgagcagctagcatgggggacgaagaagatgatcctgactggctccgcgcgtttcaggcaccaactgtggcacctgtgatgctttcttctggttcagatacctcccctgaagctagtcctacaagaaccagtacatctagaaaacaaaacaagggagagaagcacgctagtccagatcatgcacgtgatagagatggtgcttcacaaaataaaaacaaaatctcagcagctactagaagaaaaaaccttgtcagtaaaaaagaggggtcaactatggatgaaaaacaagctaatactcctagacgcttgactccaaagaaggatatggtaacactttcatctggttctgatgcttcaccgggaaacagcctttcgagggcccatgaagataaccatgaagagggctcacttagcactgccaagagaaagaatgctcaacaaactaagactaaaaaaacaaaggatgctggaacaaaaactggtgcagaccaagcagggaatggagatgctgaggatgatgtgcaagataaactcacagggaactctgtctcccagaggttaccattaatatttccagataaagttcaacgttcaaaggcattgattgaatgtgatggtgactcgatagatttaagtggagatattggtgcggttgggaggatagtagtttcaaatggtcctactgcaaaacaggatttgttgttggacctgaaaggaacaatatacaaaacaactatagttccatccaggacattttgtgttgtgagtgtgggacaatcagaagcaaagatagaggctataatgaatgacttcattcaactggaaccacaatccaatttatttgaagcagagactatggtggaaggtacccttgatggattcacatttgattcagatgaggagggtgacaaactctatgaaccacaggctaatcaaaacgatctgaataataacgaagatgaaggtcaacctaaggcaaagaccaaaaggaaagcagagaaaacaacggggaaggcaccgaagaaggcgaaggttgcaggaaagggccctaaaaagggcacgaggaaaacccaacctgcgaagagaggtaggaaggctaagaaatgatgacatgttgatttcctcggataagaagaaaaagtctattgagaacctggatagctggcaacaaagatgtgaatttttcaacgcatagtcatggctgtgaggcgcgtcgtcagttcaacatcatgcagtacttgttttagagagagagaacatgtaaagctgtaaacgttgttgtgtactctatgagcgttcagctttggatcattgaaaagaccgagatgttcacgtggaggcgaactgacttctctattttttttcacaaattaaaatctatcagtaaggctttgttcgtttatgcc

SEQ ID NO: 36 - DNA, 2345 bp, Zea Mays
tccctggggccagcctcgtcaactccgcttccggttctggcccattggcgttgcttcacatcgacgcgcctgcgccgccggtccgccgcgccttcccctcccttctcccccgcgtgccctcctattccttctctgcggcggcgtggggagctgcatctgccttcgtctggaggagtgggaagaagcgctgccgaaggggtgatttacgaagccagagagcggctgggagcaagagtgcctgggactgggagttgaagctagagaggctagttgcttgtttggtgcgctgccaaaccgccctcaacatctgacccgtctctccctcacttccacggttccagcgagcggcgcaaccgcgcaactgagcagctagcatgggggacgaagaagatgatcctgactggctccgcgcgtttcagatacctcccctgaagctagtcctacaagaaccagtacatctagaaaacaaaacaagggagagaagcacgctagtccagatcatgcacgtgatagagatggtgcttcacaaaataaaaacaaaatctcagcagctactagaagaaaaaaccttgtcagtaaaaaagaggggtcaactatggatgaaaaacaagctaatactcctagacgcttgactccaaagaaggatatggtaacactttcatctggttctgatgcttcaccgggaaacagcctttcgagggcccatgaagataaccatgaagagggctcacttagcactgccaagagaaagaatgctcaacaaactaagactaaaaaaacaaaggatgctggaacaaaaactggtgcagaccaagcagggaatggagatgctgaggatgatgtgcaagataaactcacagggaactctgtaaagtgccaactcacccatctctccattttattctttttgctccttcaaatttggatgtgaaactctaggcctttagctattttcagttgtatatctgcagctctttgatggagtttatgctcctctaaatgccaggtctcccagaggttaccattaatatttccagataaagttcaacgttcaaaggcattgattgaatgtgatggtgactcgatagatttaagtggagatattggtgcggttgggaggatagtagtttcaaatggtcctactgcaaaacaggatttgttgttggacctgaaaggaacaatatacaaaacaactatagttccatccaggacattttgtgttgtaagttatgttccaaacccaagtagagatttattgttttgtgatggtgttttaaccctcgatgtattttcctttcaggtgagtgtgggacaatcagaagcaaaggttagctatccactgtcgatttacacatagcatttagtgtactatttctgcttgttaattgggttacgtgttcaatttctcaattccacttccattccaaggcaattattcgccacaacccacccactgttttttctgtgcagatagaggctataatgaatgacttcattcaactggaaccacaatccaatttatttgaagcagagactatggtggaaggtacatacttccgacagttactgcagggtgccggctaatatgacttcgtttttctccagagtgtctctaatgtataaaattggcatgcataaagcaaatttgtaaatagtagcatggtcgtatcgtttttttatcgagctatttctttgtgcatcgacatttgtggctgtagcttcattcttgcactatgaggaagtaaccaggcttcatgaagatgtggttccattatttatatgataatagcctgtgctacaatttttctgctctaatattaaagatctatcattcgtttaggtacccttgatggattcacatttgattcagatgaggagggtgacaaactctatgaaccacaggctaatcaaaacgatctgaataataacgaagatgaaggtcaacctaaggcaaagaccaaaaggaaagcagagaaaacaacggggaaggcaccgaagaaggcgaaggttgcaggaaagggccctaaaaagggcacgaggaaaacccaacctgcgaagagaggtaggaaggctaagaaatgatgacatgttgatttcctcggataagaagaaaaagtctattgagaacctggatagctggcaacaaagatgtgaatttttcaacgcatagtcatggctgtgaggcgcgtcgtcagttcaacatcatgcagtacttgttttagagagagagaacatgtaaagctgtaaacgttgttgtgtactctatgagcgttcagctttggatcattgaaaagaccgagatgttcacgtggaggcgaactgacttctctattttttttcacaaa

SEQ ID NO: 37 - DNA, 1840 bp, Zea Mays
tccctggggccagcctcgtcaactccgcttccggttctggcccattggcgttgcttcacatcgacgcgcctgcgccgccggtccgccgcgccttcccctcccttctcccccgcgtgccctcctattccttctctgcggcggcgtggggagctgcatctgccttcgtctggaggagtgggaagaagcgctgccgaaggggtgatttacgaagccagagagcggctgggagcaagagtgcctgggactgggagttgaagctagagaggctagttgcttgtttggtgcgctgccaaaccgccctcaacatctgacccgtctctccctcacttccacggttccagcgagcggcgcaaccgcgcaactgagcagctagcatgggggacgaagaagatgatcctgactggctccgcgcgtttcaggcaccaactgtggcacctgtgatgctttcttctggttcagatacctcccctgaagctagtcctacaagaaccagtacatctagaaaacaaaacaagggagagaagcacgctagtccagatcatgcacgtgatagagatggtgcttcacaaaataaaaacaaaatctcagcagctactagaagaaaaaaccttgtcagtaaaaaagaggggtcaactatggatgaaaaacaagctaatactcctagacgcttgactccaaagaaggatatggtaacactttcatctggttctgatgcttcaccgggaaacagcctttcgagggcccatgaagataaccatgaagagggctcacttagcactgccaagagaaagaatgctcaacaaactaagactaaaaaaacaaaggatgctggaacaaaaactggtgcagaccaagcagggaatggagatgctgaggatgatgtgcaagataaactcacagggaactctgtaaagtgccaactcacccatctctccattttattctttttgctccttcaaatttggatgtgaaactctaggcctttagctattttcagttgtatatctgcagctctttgatggagtttatgctcctctaaatgccaggtctcccagaggttaccattaatatttccagataaagttcaacgttcaaaggcattgattgaatgtgatggtgactcgatagatttaagtggagatattggtgcggttgggaggatagtagtttcaaatggtcctactgcaaaacaggatttgttgttggacctgaaaggaacaatatacaaaacaactatagttccatccaggacattttgtgttgtgagtgtgggacaatcagaagcaaagatagaggctataatgaatgacttcattcaactggaaccacaatccaatttatttgaagcagagactatggtggaagatgaggagggtgacaaactctatgaaccacaggctaatcaaaacgatctgaataataacgaagatgaaggtcaacctaaggcaaagaccaaaaggaaagcagagaaaacaacggggaaggcaccgaagaaggcgaaggttgcaggaaagggccctaaaaagggcacgaggaaaacccaacctgcgaagagaggtaggaaggctaagaaatgatgacatgttgatttcctcggataagaagaaaaagtctattgagaacctggatagctggcaacaaagatgtgaatttttcaacgcatagtcatggctgtgaggcgcgtcgtcagttcaacatcatgcagtacttgttttagagagagagaacatgtaaagctgtaaacgttgttgtgtactctatgagcgttcagctttggatcattgaaaagaccgagatgttcacgtggaggcgaactgacttctctattttttttcacaaa

SEQ ID NO: 38 - DNA, 1866 bp, Zea Mays
tccctggggccagcctcgtcaactccgcttccggttctggcccattggcgttgcttcacatcgacgcgcctgcgccgccggtccgccgcgccttcccctcccttctcccccgcgtgccctcctattccttctctgcggcggcgtggggagctgcatctgccttcgtctggaggagtgggaagaagcgctgccgaaggggtgatttacgaagccagagagcggctgggagcaagagtgcctgggactgggagttgaagctagagaggctagttgcttgtttggtgcgctgccaaaccgccctcaacatctgacccgtctctccctcacttccacggttccagcgagcggcgcaaccgcgcaactgagcagctagcatgggggacgaagaagatgatcctgactggctccgcgcgtttcagatacctcccctgaagctagtcctacaagaaccagtacatctagaaaacaaaacaagggagagaagcacgctagtccagatcatgcacgtgatagagatggtgcttcacaaaataaaaacaaaatctcagcagctactagaagaaaaaaccttgtcagtaaaaaagaggggtcaactatggatgaaaaacaagctaatactcctagacgcttgactccaaagaaggatatggtaacactttcatctggttctgatgcttcaccgggaaacagcctttcgagggcccatgaagataaccatgaagagggctcacttagcactgccaagagaaagaatgctcaacaaactaagactaaaaaaacaaaggatgctggaacaaaaactggtgcagaccaagcagggaatggagatgctgaggatgatgtgcaagataaactcacagggaactctgtaaagtgccaactcacccatctctccattttattctttttgctccttcaaatttggatgtgaaactctaggcctttagctattttcagttgtatatctgcagctctttgatggagtttatgctcctctaaatgccaggtctcccagaggttaccattaatatttccagataaagttcaacgttcaaaggcattgattgaatgtgatggtgactcgatagatttaagtggagatattggtgcggttgggaggatagtagtttcaaatggtcctactgcaaaacaggatttgttgttggacctgaaaggaacaatatacaaaacaactatagttccatccaggacattttgtgttgtgagtgtgggacaatcagaagcaaagatagaggctataatgaatgacttcattcaactggaaccacaatccaatttatttgaagcagagactatggtggaaggtacccttgatggattcacatttgattcagatgaggagggtgacaaactctatgaaccacaggctaatcaaaacgatctgaataataacgaagatgaaggtcaacctaaggcaaagaccaaaaggaaagcagagaaaacaacggggaaggcaccgaagaaggcgaaggttgcaggaaagggccctaaaaagggcacgaggaaaacccaacctgcgaagagaggtaggaaggctaagaaatgatgacatgttgatttcctcggataagaagaaaaagtctattgagaacctggatagctggcaacaaagatgtgaatttttcaacgcatagtcatggctgtgaggcgcgtcgtcagttcaacatcatgcagtacttgttttagagagagagaacatgtaaagctgtaaacgttgttgtgtactctatgagcgttcagctttggatcattgaaaagaccgagatgttcacgtggaggcgaactgacttctctattttttttcacaaattaaaatctatcagtaaggctttgttcgtttatgcc

SEQ ID NO: 39 - DNA, 485 bp, Zea Mays
gatttatttacttggaacaatgcttgtcgcaacatcatagtgcacctgcctgatggaggattctaatctgtttcccgtgacctgcaggggaaggcaccgaagaaggcgaaggttgcaggaaagggccctaaaaagggcacgaggaaaacccaacctgcgaagagaggtaggaaggctaagaaatgatgacatgttgatttcctcggataagaagaaaaagtctattgagaacctggatagctggcaacaaagatgtgaatttttcaacgcatagtcatggctgtgaggcgcgtcgtcagttcaacatcatgcagtacttgttttagagagagagaacatgtaaagctgtaaacgttgttgtgtactctatgagcgttcagctttggatcattgaaaagaccgagatgttcacgtggaggcgaactgacttctctattttttttcacaaattaaaatctatcagtaaggctttgttcgtttatgcc

SEQ ID NO: 40 - DNA, 2262 bp, Zea Mays
atggcagacctcccaccctctaagccagcccttccctctcaccctctaacccagtccttcccacccagttctgatgccccctcccacctcagcccctcgccggcattctccccgaactcggcgtccacacccacttttagccaggcgttagaacctagtcacagtggtgtatcttctcaggtaggacggtccaaattccagaggtggagcgacggaggtggtggtccattttccggtgagccctgttcctataaagatgctacactcatccagttgagtgcagtgccatcctctccttctcggggatcacagttgaggtctgcaaaggaggtggtggtccggggtcacgtcgaggacctccggcaggcggtctctgggcgacgtcaagaaggtctgacgccctactcgctgtttccgctgtcgtcttcttgggcatcaagcaaggaggtgtccctctcttctcccggtagagaaagggacgtctggaaagccaccaagatgtctgtgtggcaaagaattggccctcagctgccgccgtcgaagttttctcattctccggcagcagaggcaagcttggtggagagcaatatctcgagtcattctggtaagaagaagaggaggcgggccaaatgtcataaggaggtttcttggcagtccacagcgccggtgggtgccgcttcgaccttggagccctcgccaggagtagggacgcagtcgagagtgaagacctgcgtgcttgagttctccactgctatggctcgggaggaggcggctcttcgccgggctttattcgtctctattgttggcagcaggccggagatcagtggagctgaagtgcgggatgaagtggctcgggcttttggaattgacgttaattcaatatcgattcatcagtccttgccagaagatttcctattgttgttaccggatgaaagttcggctgatagagtctttagcggaggaaaattgtttaggggccctcttttcaatcttcaattcagacggtggtcgcggttggctcatgctgaggcggctaggttgccagcactggtggaagtcgaggttcatggcatccctgcccacgcatgggatcgttctacggcggagtatctgctccgtgactcttgcattatcacagacattcatccgagcacgtcattgaagaatgatctgtcttccttcaggctttgtgcatggtgttcgaacacagatttgttccctcggtcgatgaagctcctcattgttgagccggggacggatgtgcacgagaaaagatgtctttcctatgatattgaggtggctgttactgctgtgatggaggtgcctccccctgtgcggcggctggctgttaattctgtggcgggagtcgaggaggtggcctcttcaatgggacgagcggtccattctccttcatggttggcggcaggcacaggaaccgaggcgcacattgggagaatgctggcggccgacataggaaccgagacgcactctgggggaatgctggtggtcagcataggagccgaggcacacactgggagcatggtggtcgttcctgccagggaggtgttggctgtccatatggaactcacggcagcagacatgggcacaggtcccgggacagactgcgcaaagttgtgcaacagccgcagatggatgggcacggggggccatgtggacaaggttggctgggtcgctgaaaccgcttgggtcgggctctccccgacagaggtccttgagagccccagactgaaggtgtactcaagattgaaaaagggcagacttcagatacctgcatcggtttcatcccagatggaggtgtcggcaccagttttggatctggtacctgctggtgtttcttctcagttggaggaggcgacccccgttatgaaactggtggctaatatcacaagggacattgactgcttgcttccgcaacctccaattcaaaaaagaagaactaaacagcttccgccagattttgtcccacgtcacagtagtcgcttgtcaaagaaaagggaaggcttaaattcaacagtcagacaagtccaggcggagctcatgttgaagttgaacgtcacaaactcacaggtggctgtgactgatgaaatgctggaggaatttggacagctgtttgacaaacccctttccaactctcacatcaaggccctggcagctttgtttggatggccggtcccagataatgtgcaagaatgcttggatgttcctttgcttagggagttaagcattgaaacgtgtgcttga

SEQ ID NO: 41 - DNA, 687 bp, Zea Mays
atgaagttaagatacataccagttctctatgcaacattttggaaatacgcctatatgagagtttgtaaaaatattccatctgaactgccagatcctacatcttcattttttaacagactgacaagttctctagaacctgttgatttcacaggagaggatcttttggtgattgctgctgatcaaccatttcgcttcccttccacatttacatttgtggtcagagcattctcagttctagatggtattaggaaaggccttgatcctaggtttcatattacagagattgctaagcccttgcacatcttcacatatccaattgtttcaacaattggatatgtgcggtgcagggacaacgagctatgcagcgccgccggcgccaaggtggtggtgacggaccaagcgcggatgtcgaaccgcacagccctggtgctgagcgccgcggcgtacgcggccatagccagcgccggcaaggccgcgcgcctcagggaccggcgcgttgtcgacgtcgagtacaagagggtaccctacgagtacgcgaaggaccgcaacctgtcgatacgcgtggaggagaagatccggccgccaagcaacctgtccatcaggatcctgtaccagggcggccagaccgacatcgtcgccgtcgacgtcgccaccggcgcccgtaagggcgccgcctgttctagttag

SEQ ID NO: 42 - DNA, 842 bp, Zea Mays
gcagcaacaccgcccccggcctcgctttgcagccccctccctccaccgcctcctccacgccctagcgctccggcccccgccccgagctcgtcgtggccggctgcgctgcggtgcccgcacctgtgggggcgtgcgggccggtggtgaaacgacccgcgacctcggtgcctctcgacgtctgcccgcttcctcgccggcgccattttgttcgtctaaatcccctgtgataagcaccactgctcgtgatgcattcttcggaaaataaactgggttggaatgagacctctatggggttggttcctgtaccaaaaagaccagctagacctgatgcttcccaccaatgcaaatctgattcctttatgaagcgatcaccaaggaaagttagaaatgctactctggcaaaaagcataaagagcaaataccactatagtcccctcaaacagcggaagggttcagattctgttcctgggaaaatcgtaacaggactaaccgcaaggaaaaagaagaaaaggaaaatccaaattacagacgaggcaactcgtttggaacgaagagcgagatattttctaatcaagataaaactggagcagaatttgctagatgcttactctggagatggatggaatgggcaaaggtgcattccctgctctttctgctgtaatctgctggtgtaaagaaagttttcaaatctatatacatccttgtagagtcaatgcattcttttgaactttggaacctgaaaaatgctgtcttatcttgtcacgatgaatagaggaaagttcacggaaagtgtaatgtagcttttaaggcttgcaacaagatgcttattattttgaaactta

SEQ ID NO: 43 - DNA, 2797 bp, Zea Mays
gcagcaacaccgcccccggcctcgctttgcagccccctccctccaccgcctcctccacgccctagcgctccggcccccgccccgagctcgtcgtggccggctgcgctgcggtgcccgcacctgtgggggcgtgcgggccggtggtgaaacgacccgcgacctcggtgcctctcgacgtctgcccgcttcctcgccggcgccattttgttcgtctaaatcccctgtgataagcaccactgctcgtgatgcattcttcggaaaataaactgggttggaatgagacctctatggggttggttcctgtaccaaaaagaccagctagacctgatgcttcccaccaatgcaaatctgattcctttatgaagcgatcaccaaggaaagttagaaatgctactctggcaaaaagcataaagagcaaataccactatagtcccctcaaacagcggaagggttcagattctgttcctgggaaaatcgtaacaggactaaccgcaaggaaaaagaagaaaaggaaaatccaaattacagacgaggcaactcgtttggaacgaagagcgagatattttctaatcaagataaaactggagcagaatttgctagatgcttactctggagatggatggaatgggcaaagccgagagaaaataaagccagagaaggaactgcaacgtgccaggaaacaaatcataaaatgcaaaattgctatacgtgatatcatccgccaacttgatttgtatacttctactgggagtgttgatgacccactaatgcctacagatcagtccaccaatcccgaacataccatgtgctcaacatgcaagtctcatgaatcatttcccagcaataaaattatcttctgcaaagggccctgcaaaagggcatgtcatgagaaatgtttggaacctcccttaaacaaaagcgtacttccaacaagtagccatgggtggctttgcaaattctgtttgtgcaaggtgaggattttagaaactattaatgcacatctagggacgagttttacagtgaagtgccactttgaagatatattcaaggaaactactgaactaatagactctgaggatgcactagatgaagattggctttctgagtattcaggtgatgaggactatgatcctgatgaaaatgaggccagtggcgactgtatggacagcggggagaagattatgtctgatgattccaatggttcaggaagccccctttattctccaaatgacgatattcctgacttcatatcagcagacttaaatgttgtggaagggttttgtcataccaatttagatttaggcattgatgccgttgaagatgattttgcacagatcctcacctaccaaaggccaagaagagatgttgattatagaaggcttaacgaggaaatgtttgggaaaataaccgggaatgaagaacagagcgaggacgaagattggggccatgaaaggagaaagaaaaggacacattcaggtgttgctggggataattctgttggtttcttgaacgttatatctgatgaaaagagccagaagaaggggagaaaacttttcaggattcctcctgcagctgttgaggtacttcgcagagcttttgctgaaaatgagcttccaccccgggatgttaaagaaaatctctcaagagaattgggaatttcttttgaaaagattgataaatggttcaaaaatacacggtgtgctgctctcagagatcggaaggctgaaggaaacagtcataatacagctcccagcaaaagctcaaaaaataaaggaaaagctggaatctcagactggaaggaatggtcatgttactggtccctgcaataatttgagaacaaatgaagaaaaaacaggtatatcggggaagtttgattcaggagacaactcttgtttggttcccttctctgaagtcatcaatgtgcctacgcgattgccacacaactttgagatgaggaagatggaatcaactagaagtcctgcgaggctacacaataaaggagggttcctgtctgcaacagtccaaattaaggagagtacgttgttacccacaggcaagccttgttggcagtcagaaatgagccatccaacaactaatgaagtgagcacttcagcgcaagctactacttggatcgacgcgggggcgtgtgccgaggagcaagaacctactccttgggtggacatcggggtctcagactaccagcctttcctggatgtgatcgacgacatgtgcggacttgagtggaggctgcagagactgaaggagaacatgctctcatctagcatagacggccaaaccgccgccagtgagagtgacaaaagaaaccagaccgtggtgctagtgccaaccgccgagctcaaggaaaagctgccgcatgacggtttattcgggcattattgcccataggtcttatatacatagcggataaactgtacagagaaccaagaagaagaagaaaacaaaagggaaacagcaaacagacaggtgcccgcttacataccggtccatactgtcaggcactactctcctttcttgggcctcgacacgactaatactgtgctagtccagaacagatgagccatagccattacctgtgtgcctcccaggttcagttcatatgttgtatgtattaatgtatatcagaagagtcgtgcttagtagtagcaagaacctagtcctgatccagaccgtgaatctggatcatcttgtcctgtggttgtaccgtgcagaacagacagatgtcggctagtcgtttggttctgaagtaagaaactataagcatgcgtgattttggccc

SEQ ID NO: 44 - DNA, 2802 bp, Zea Mays
gcagcaacaccgcccccggcctcgctttgcagccccctccctccaccgcctcctccacgccctagcgctccggcccccgccccgagctcgtcgtggccggctgcgctgcggtgcccgcacctgtgggggcgtgcgggccggtggtgaaacgacccgcgacctcggtgcctctcgacgtctgcccgcttcctcgccggcgccattttgttcgtctaaatcccctgtgataagcaccactgctcgtgatgcattcttcggaaaataaactgggttggaatgagacctctatggggttggttcctgtaccaaaaagaccagctagacctgatgcttcccaccaatgcaaatctgattcctttatgaagcgatcaccaaggaaagttagaaatgctactctggcaaaaagcataaagagcaaataccactatagtcccctcaaacagcggaagggttcagattctgttcctgggaaaatcgtaacaggactaaccgcaaggaaaaagaagaaaaggaaaatccaaattacagacgaggcaactcgtttggaacgaagagcgagatattttctaatcaagataaaactggagcagaatttgctagatgcttactctggagatggatggaatgggcaaagccgagagaaaataaagccagagaaggaactgcaacgtgccaggaaacaaatcataaaatgcaaaattgctatacgtgatatcatccgccaacttgatttgtatacttctactgggagtgttgatgacccactaatgcctacagatcagtccaccaatcccgaacataccatgtgctcaacatgcaagtctcatgaatcatttcccagcaataaaattatcttctgcaaagggccctgcaaaagggcatgtcatgagaaatgtttggaacctcccttaaacaaaagcgtacttccaacaagtagccatgggtggctttgcaaattctgtttgtgcaaggtgaggattttagaaactattaatgcacatctagggacgagttttacagtgaagtgccactttgaagatatattcaaggaaactactgaactaatagactctgaggatgcactagatgaagattggctttctgagtattcaggtgatgaggactatgatcctgatgaaaatgaggccagtggcgactgtatggacagcggggagaagattatgtctgatgattccaatggttcaggaagccccctttattctccaaatgacgatattcctgacttcatatcagcagacttaaatgttgtggaagggttttgtcataccaatttagatttaggcattgatgccgttgaagatgattttgcacagatcctcacctaccaaaggccaagaagagatgttgattatagaaggcttaacgaggaaatgtttgggaaaataaccgggaatgaagaacagagcgaggacgaagattggggccatgaaaggagaaagaaaaggacacattcaggtgttgctggggataattctgttggtttcttgaacgttatatctgatgaaaagagccagaagaaggggagaaaacttttcaggattcctcctgcagctgttgaggtacttcgcagagcttttgctgaaaatgagcttccaccccgggatgttaaagaaaatctctcaagagaattgggaatttcttttgaaaagattgataaatggttcaaaaatacacggtgtgctgctctcagagatcggaaggctgaaggaaacagtcataatacagctcccagcaaaagctcaaaaaataaaggaaaagctggaatctcaggcaagactggaaggaatggtcatgttactggtccctgcaataatttgagaacaaatgaagaaaaaacaggtatatcggggaagtttgattcaggagacaactcttgtttggttcccttctctgaagtcatcaatgtgcctacgcgattgccacacaactttgagatgaggaagatggaatcaactagaagtcctgcgaggctacacaataaaggagggttcctgtctgcaacagtccaaattaaggagagtacgttgttacccacaggcaagccttgttggcagtcagaaatgagccatccaacaactaatgaagtgagcacttcagcgcaagctactacttggatcgacgcgggggcgtgtgccgaggagcaagaacctactccttgggtggacatcggggtctcagactaccagcctttcctggatgtgatcgacgacatgtgcggacttgagtggaggctgcagagactgaaggagaacatgctctcatctagcatagacggccaaaccgccgccagtgagagtgacaaaagaaaccagaccgtggtgctagtgccaaccgccgagctcaaggaaaagctgccgcatgacggtttattcgggcattattgcccataggtcttatatacatagcggataaactgtacagagaaccaagaagaagaagaaaacaaaagggaaacagcaaacagacaggtgcccgcttacataccggtccatactgtcaggcactactctcctttcttgggcctcgacacgactaatactgtgctagtccagaacagatgagccatagccattacctgtgtgcctcccaggttcagttcatatgttgtatgtattaatgtatatcagaagagtcgtgcttagtagtagcaagaacctagtcctgatccagaccgtgaatctggatcatcttgtcctgtggttgtaccgtgcagaacagacagatgtcggctagtcgtttggttctgaagtaagaaactataagcatgcgtgattttggccc

SEQ ID NO: 45 - DNA, 2885 bp, Zea Mays
gcagcaacaccgcccccggcctcgctttgcagccccctccctccaccgcctcctccacgccctagcgctccggcccccgccccgagctcgtcgtggccggctgcgctgcggtgcccgcacctgtgggggcgtgcgggccggtggtgaaacgacccgcgacctcggtgcctctcgacgtctgcccgcttcctcgccggcgccattttgttcgtctaaatcccctgtgataagcaccactgctcgtgatgcattcttcggaaaataaactgggttggaatgagacctctatggggttggttcctgtaccaaaaagaccagctagacctgatgcttcccaccaatgcaaatctgattcctttatgaagcgatcaccaaggaaagttagaaatgctactctggcaaaaagcataaagagcaaataccactatagtcccctcaaacagcggaagggttcagattctgttcctgggaaaatcgtaacaggactaaccgcaaggaaaaagaagaaaaggaaaatccaaattacagacgaggcaactcgtttggaacgaagagcgagatattttctaatcaagataaaactggagcagaatttgctagatgcttactctggagatggatggaatgggcaaagccgagagaaaataaagccagagaaggaactgcaacgtgccaggaaacaaatcataaaatgcaaaattgctatacgtgatatcatccgccaacttgatttgtatacttctactgggagtgttgatgacccactaatgcctacagatcagtccaccaatcccgaacatgtatgtatgttatcaagtgaaggtcagatgctctacttcattggatctatcaactgataaattgtcaatatttattttgctagaccatgtgctcaacatgcaagtctcatgaatcatttcccagcaataaaattatcttctgcaaagggccctgcaaaagggcatgtcatgagaaatgtttggaacctcccttaaacaaaagcgtacttccaacaagtagccatgggtggctttgcaaattctgtttgtgcaaggtgaggattttagaaactattaatgcacatctagggacgagttttacagtgaagtgccactttgaagatatattcaaggaaactactgaactaatagactctgaggatgcactagatgaagattggctttctgagtattcaggtgatgaggactatgatcctgatgaaaatgaggccagtggcgactgtatggacagcggggagaagattatgtctgatgattccaatggttcaggaagccccctttattctccaaatgacgatattcctgacttcatatcagcagacttaaatgttgtggaagggttttgtcataccaatttagatttaggcattgatgccgttgaagatgattttgcacagatcctcacctaccaaaggccaagaagagatgttgattatagaaggcttaacgaggaaatgtttgggaaaataaccgggaatgaagaacagagcgaggacgaagattggggccatgaaaggagaaagaaaaggacacattcaggtgttgctggggataattctgttggtttcttgaacgttatatctgatgaaaagagccagaagaaggggagaaaacttttcaggattcctcctgcagctgttgaggtacttcgcagagcttttgctgaaaatgagcttccaccccgggatgttaaagaaaatctctcaagagaattgggaatttcttttgaaaagattgataaatggttcaaaaatacacggtgtgctgctctcagagatcggaaggctgaaggaaacagtcataatacagctcccagcaaaagctcaaaaaataaaggaaaagctggaatctcaggcaagactggaaggaatggtcatgttactggtccctgcaataatttgagaacaaatgaagaaaaaacaggtatatcggggaagtttgattcaggagacaactcttgtttggttcccttctctgaagtcatcaatgtgcctacgcgattgccacacaactttgagatgaggaagatggaatcaactagaagtcctgcgaggctacacaataaaggagggttcctgtctgcaacagtccaaattaaggagagtacgttgttacccacaggcaagccttgttggcagtcagaaatgagccatccaacaactaatgaagtgagcacttcagcgcaagctactacttggatcgacgcgggggcgtgtgccgaggagcaagaacctactccttgggtggacatcggggtctcagactaccagcctttcctggatgtgatcgacgacatgtgcggacttgagtggaggctgcagagactgaaggagaacatgctctcatctagcatagacggccaaaccgccgccagtgagagtgacaaaagaaaccagaccgtggtgctagtgccaaccgccgagctcaaggaaaagctgccgcatgacggtttattcgggcattattgcccataggtcttatatacatagcggataaactgtacagagaaccaagaagaagaagaaaacaaaagggaaacagcaaacagacaggtgcccgcttacataccggtccatactgtcaggcactactctcctttcttgggcctcgacacgactaatactgtgctagtccagaacagatgagccatagccattacctgtgtgcctcccaggttcagttcatatgttgtatgtattaatgtatatcagaagagtcgtgcttagtagtagcaagaacctagtcctgatccagaccgtgaatctggatcatcttgtcctgtggttgtaccgtgcagaacagacagatgtcggctagtcgtttggttctgaagtaagaaactataagcatgcgtgattttggccc

SEQ ID NO: 46 - DNA, 2537 bp, Zea Mays
gaaccctttcttcctcctcatcccccaagccccaaccagctccaattccccccccccccccccccccccatacaatatcttttctctctcatcctccaaaggaccaagaagtaccatttctgctctctccattcgtctccaatcccaacacagcttctcaattcagttcagggaattctcccttttcttttgttttgctctagtgctcttggctgtttactccgcttcttatcctcttctctccacagaagaggagtgcatgtgcagcagctgtaaagacagtatttttttttcacctcatcttctcccaaggtgttgttggtgccccaggtggaggcaactgccaaagtgtttgggtttcttgaatgttaggcttttttggggaggaggaaagggcttgatcgattaggttgttcagccattcttgccccagtgttcttggattcatggtcgtggaattaatccaagggtagctggaggctggagctgctccatttcccttccgagaaaacgaaggcgaaggcgatcgtttgaacggttacagctgttgccgttgagccggtgcaatgtcgtcttcctgcatgccgacgggcctgcggctggacctggacatggtgaaggcggcggcgtcgccgggcgcgcactcgtcgccgctgcgcccggtgcactcgtcgccgtcgtcgacgctgtcggaggcgtccaacgcgtcgtcgtcggcgacgtccgtgtcgctgaagcgggcgcgcgcgccgcggaagcggccgaaccaggcgtacaacgaggccgccgcgctgctggcgtccatccacccctccgtcttccccgtcaagaagagccccaagacggcgccgccgcgcccgccgtcgtcgcggcagctctccgggctcgcggcggcgctcgacgcctcctcctccgacctcctcccgccgctccccgtcctcgccgactccgcattcctgctccgagacatacccgcgccgtcgccgctgccgcagccgcagagcccgtccgccgccaagaactgctcgtcgccggcccccgtgagcagcgcgttccgggacttccgcgacccggcgccgtcgccggcgagccccgacaccgtcgacgtcaacgagctcggcgagatcgacttcgacgacgacggcttcgacgccgagtccatcctcgacgtcgaggaggccgcggccgcggccgagggcctcgacggcatcatgggcagcctcaccgtcgagagcaacagcaccgccgccaccacgtccgatgactccatcctgtccagctccggcatccacccctacctcaggagcctcatggtggtcggcctcgccggcaggttcgagctcggcctcgggtcccggcacggcgctcggcccaacctcaaccgcgcactgaagcggcgggacgacgatggcgcctggtggatgtggccggcagtgccggtaaaggacctaacggttgcaccaccgacaccgccggcgtcaaacgccgcagtgtcacagccacagcccgccgccgctccggagaagaacaaaagcaagaagaagaaggtggtgaaggtggagaaggtcatgatgggggcgaagggaaaagaggagctgcttcccagcgcgaaatgcaaggaggaggaagctgatggcgacggcgacgctgaaagcgcgccggtgaaggcgccaaagaccgggctggggctgaagctggacgccgacgaggtgctcaaggcgtggtccgacagagggtccatgtttgccgagggaagcgcgccggagtcgccgacatcggtcgccgaagcgcgggccaagctctcagacatggacctgtttccggagaacgaagccggcgccggcgccggcggcgtcagggaggccagcgtgctgcggtacaaggagaagaggcgcacccggctcttctccaagaagatccggtaccaggtgcgcaaggtgaacgccgactgccggcctcggatgaaggggaggtttgttaggagcccgtctcttcttcggcaagccctggaggaagagagctagctagacagacacaggcagtggtcctcgctagccttttcttttcttttagttttttttttcaaagcaactttttgttcctctagttcctcgttagctaagactaagagatgtgagtgagaaattttcccagttttttttttgtttcatcggagttttgctctggagaggataggtgaggatggctttagcgtgggttgtcatggcatggtggtcacatagtttgtctcaggtttacaatgtgagaggtaaaggaaggaaataaagcggtgttagaagaacataccgtcatacagcaagcagctccagatgatgggttctgttgtgcttttactgctccagaatatcaatcgcgttgctctgtaacatccattgcgaagaagaaaacgacgagtacaaattagcacggattgttatgcgctagtaagtagcgcgtaagtatttttcttctttaatcagctgacagcatctgctgttcagcggtaaaagtatctgcagtgcggtcactgccaaaat

SEQ ID NO: 47 - DNA, 1779 bp, Zea Mays
tcccctctcccggtcctccccacccccatccctcctcacggtcacggcacgggactcgcctccccccctcctcttcctcccctcccgcccacggctggaggtgctcacagcgagcggagcggaggcgagggattcggccgcgcgcatggcgacgcctctctgaccgaagctgctccacccactcggccaggcgcgccgtcctctcctctcccctccccttatcctctcgttacaaaatggcgatgatggtggatcctccgaatggaatcgggaaccaaggaaagcattactactcaatgtggcagaccttatttgagatagacaccaaatatgtaccgatcaagcccattggtcgaggagcttatgggatagtttgttcatccattaatcgtgaaacaaatgagaaagtagcaataaagaagatacacaacgttttcgacaaccgtgtggatgcactacggaccttgcgggagctgaaactccttcgccatctccggcatgagaatgtcattgctttgaaggatataatgatgccaatacacaggagaagctttaaggatgtgtacttggtatacgaactcatggatactgatttgcaccagataatcaaatcacctcagggcctttccaatgaccactgccagtattttctttttcagttgctccgaggactcaaatatctccattcagcagaaatactccacagagacctaaaacctggaaacctgctggtgaatgcaaattgtgatctgaagatatgtgattttggtctcgcacgtacaaacagtagcaaaggccagttcatgactgaatacgtcgtcacccgctggtacagagctcctgagctgctcctctgctgcgacaactacggcacatccatagacgtctggtctgttgggtgcatctttgctgagctccttggccgcaagccaatatttccaggaactgaatgcctgaatcaactcaagctcatagtgaacgtcctcggcaccatgagtgaggctgacctagagttcatcgacaacccaaaggctcggagatacatcaagtcccttccctatacccctggtgttcccctcgtaagtatgtacccacatgcgcaccctcttgccattgatctgttgcagaagatgctcatcttcgaccccaccaaaaggatcagtgtcaccgaggctctcgagcacccttacatgtcccctctgtatgatccaagcgcaaatcccccagcccaagtgcccatcgatctggacatagacgaaaacatcagctcagagatgatccgggaaatgatgtggcaggagatgcttcactaccaccctgaagttgccacagcaataagcatgtcatgagagattccacagcccccaggacatcagcgggggctcacctcttctttttttgtctttgataaaagcctactgcgagtagccgattattgcggcacctagctgttatagtacacttaatgtctgcttggaaccaattatggcgcctagctgttgtagtacccttaatgtctgcttggacacttccgcttgtgtaaatacgcgcccaataagagcggcgtatggatagatgctgtcactatggaccattacttgttgtatgcactgtatatctgtggactgttgtggtgttgtattagttcatgaaccatgaagctttgaagtaaaaatcccatgcatgttaagtttgtatgcttccctacctcttcttttgttaactctgttttctccaggagacacatcgtacatttgtaaaaaaaaaaacaagaaaaaa

SEQ ID NO: 48 - DNA, 1265 bp, Zea Mays
ccgccgcgccccctcgcgtccgttcctcccttcctttccgtgtcggtctccggcgcgcccgacgtagcgcccgcatccgacggccgtgggggcatcgacggccgggcgacgcgacgcgatgtgaccatgacccgtcagtcagcagttgctccgaggactcaaatatctccattcagcagaaatactccacagagacctaaaacctggaaacctgctggtgaatgcaaattgtgatctgaagatatgtgattttggtctcgcacgtacaaacagtagcaaaggccagttcatgactgaatacgtcgtcacccgctggtacagagctcctgagctgctcctctgctgcgacaactacggcacatccatagacgtctggtctgttgggtgcatctttgctgagctccttggccgcaagccaatatttccaggaactgaatgcctgaatcaactcaagctcatagtgaacgtcctcggcaccatgagtgaggctgacctagagttcatcgacaacccaaaggctcggagatacatcaagtcccttccctatacccctggtgttcccctcgtaagtatgtacccacatgcgcaccctcttgccattgatctgttgcagaagatgctcatcttcgaccccaccaaaaggatcagtgtcaccgaggctctcgagcacccttacatgtcccctctgtatgatccaagcgcaaatcccccagcccaagtgcccatcgatctggacatagacgaaaacatcagctcagagatgatccgggaaatgatgtggcaggagatgcttcactaccaccctgaagttgccacagcaataagcatgtcatgagagattccacagcccccaggacatcagcgggggctcacctcttctttttttgtctttgataaaagcctactgcgagtagccgattattgcggcacctagctgttatagtacacttaatgtctgcttggaaccaattatggcgcctagctgttgtagtacccttaatgtctgcttggacacttccgcttgtgtaaatacgcgcccaataagagcggcgtatggatagatgctgtcactatggaccattacttgttgtatgcactgtatatctgtggactgttgtggtgttgtattagttcatgaaccatgaagctttgaagtaaaaatcccatgcatgttaagtttgtatgcttccctacctcttcttttgttaactctgttttctccaggagacacatcgtacatttgtaaaaaaaaaaacaagaaaaaa

SEQ ID NO: 49 - DNA, 1699 bp, Zea Mays
ctgccccgccgcgccccctcgcgtccgttcctcccttcctttccgtgtcggtctccggcgcgcccgacgtagcgcccgcatccgacggccgtgggggcatcgacggccgggcgacgcgacgcgatgtgaccatgacccgtcagtcagcagtacaaaatggcgatgatggtggatcctccgaatggaatcgggaaccaaggaaagcattactactcaatgtggcagaccttatttgagatagacaccaaatatgtaccgatcaagcccattggtcgaggagcttatgggatagtttgttcatccattaatcgtgaaacaaatgagaaagtagcaataaagaagatacacaacgttttcgacaaccgtgtggatgcactacggaccttgcgggagctgaaactccttcgccatctccggcatgagaatgtcattgctttgaaggatataatgatgccaatacacaggagaagctttaaggatgtgtacttggtatacgaactcatggatactgatttgcaccagataatcaaatcacctcagggcctttccaatgaccactgccagtattttctttttcagttgctccgaggactcaaatatctccattcagcagaaatactccacagagacctaaaacctggaaacctgctggtgaatgcaaattgtgatctgaagatatgtgattttggtctcgcacgtacaaacagtagcaaaggccagttcatgactgaatacgtcgtcacccgctggtacagagctcctgagctgctcctctgctgcgacaactacggcacatccatagacgtctggtctgttgggtgcatctttgctgagctccttggccgcaagccaatatttccaggaactgaatgcctgaatcaactcaagctcatagtgaacgtcctcggcaccatgagtgaggctgacctagagttcatcgacaacccaaaggctcggagatacatcaagtcccttccctatacccctggtgttcccctcgtaagtatgtacccacatgcgcaccctcttgccattgatctgttgcagaagatgctcatcttcgaccccaccaaaaggatcagtgtcaccgaggctctcgagcacccttacatgtcccctctgtatgatccaagcgcaaatcccccagcccaagtgcccatcgatctggacatagacgaaaacatcagctcagagatgatccgggaaatgatgtggcaggagatgcttcactaccaccctgaagttgccacagcaataagcatgtcatgagagattccacagcccccaggacatcagcgggggctcacctcttctttttttgtctttgataaaagcctactgcgagtagccgattattgcggcacctagctgttatagtacacttaatgtctgcttggaaccaattatggcgcctagctgttgtagtacccttaatgtctgcttggacacttccgcttgtgtaaatacgcgcccaataagagcggcgtatggatagatgctgtcactatggaccattacttgttgtatgcactgtatatctgtggactgttgtggtgttgtattagttcatgaaccatgaagctttgaagtaaaaatcccatgcatgttaagtttgtatgcttccctacctcttcttttgttaactctgttttctccaggagacacatcgtacatttgtaaaaaaaaaaacaagaaaaaa

SEQ ID NO: 50 - DNA, 1131 bp, Zea Mays
ctcaaaaaattctagtcgccaccagcagccttcttccacctctagccggacctctgctcggcgccctcccggctcctcctgcgagcggctgcagcagggagctccctctcctcccatggcgtcctccccttcttcctcccgcatcacggcagcaagcagtcattcccatggccgagctcacctccctgccgcgagctcgccaacaatctcccccactcagatctccattccccttgctgctgctcgccgcgagctctctctggctttttccccagtcggcgccctgttcccctgcggctcccatggcgccggcgaagctcgagcagccgcgcacccaaccatggtgcccctgtttttcccagccgtgcagctccctgttcccctgtcccatggcgccccttcaggcttggcagcagggacagcacttttccccttcgactgcttccctgacacaggcgcagtgagcagtcccatggctgacgctctctgctccattccctccatggccggcgcccaacaacagtagcagccgggtctttgtcctccctctgctgtccgcggctgcagcaaacagggagctcgagtttctcccatggctgccgacctcctctgccccttgctgtcccaccccttctccctcaagcctcgccttccccgaccacatctccatggctgagcagcagctctgctcgcccccctccttctttttccccttgtgcagcagcaagaagcccctgctcgcagccttggcgtccaacttcgctacgcagcggtgccgatccaaagcagcagccccggcgtctccgcactctgcgggctcgctgttttataaagcacagtgaacagcacgccgtcgacactcgtcggttgtttgctgtttttgcgcagccccaacatcgtcgtcgttcaccccggtgagaccgcgacgctccttgttcgattccgcattgacgttattttcctatgattaattatgtatgtgtgctgctttgttttatttttgtggaggagagaaaccccgtgttttgcgtggagaagaaggcaagccgctcaacgctcgtcgatgttcggagcgatgcacaaatcggaatcgccatcgtccttacaaacaccgattgggtttgtttacgg

SEQ ID NO: 51 - DNA, 1313 bp, Zea Mays
atgcacgacggctggcgagctgggctagctcggataggaacaaccgatgggatgaccatgacaaatagaaaatcgacgaccggcgaaaccgatagccgaacaggaattgagctaacaggaattgcacagatcgacgacgcgaggcccgatctggtgagcacgacgcaaaggtgggcgtcgctgccgctgctccgacacgaagtacttgctgccgaggcagacgagcacaacggaggccggggtctgggcatcgagccagcgcatcacgcagtttggaaaccacaccacccacacgaagcgcttgccgcagagcaccagaccgcgcgccattcgcgcagagctccaaaatcgcgcgccgaactgggagccaaggcgagcgcggcaagtgagctgagggggcacgtcaggaaactcaatggcggcgatctgggcgaacgcgacacaggagaccagagtgagaggtgcgctgacgaggaagcaggaagccgcgacgagggagctcggcgcgcagactgggcgagctgggcgcgcagaggagaaaccggagagctcggctggggctggttgagggagaaccgcggcgcagagagctcagcgcggcgtcgggggcgcgtcggcagggaagcaagcgcgcgcgaggcgcgcgtggccactagagctggagggcgcgcggacgatgagcaggaagtcgcgtcgccggaggagcaggggagatgggtgtcgtacaggggcaggtcgagcgcgctagggagctgccgcgcggggaagaagccggctgcgcgcggcaaacagagagcgggaacccgggcgcgcgatatccggtggagaagcaggacgttgccgcggccatggaaagcaggcgcggctgggctgggcgatccagggacgcgcagggagcaggacgcgccatgggagcacggaggggaagccgctcggctgggaggagagaagcgaagctcggccggcggctgcctgaagaaagagcagaggacgctggcgttgagggcagggccgagctcggcggccatggccgaacagagagcagagcaggggcgcggacggcggaactccggatcggcgcggctggaagaagctcggcgagcagagaggactggagggagctcggcggccatggcaggggctcgcggccggcagagagctagcgccacggagagaagaaaaatcctgggcacgcgtgcacagggagttcggcacggtgcggcgggagattgaagaaaggggaggaacgccgtggggcagggcgagctcgccagagatggagctcggtcgctgctgaggaagagagggagcag

SEQ ID NO: 52 - DNA, 2687 bp, Zea Mays
cggttcaccctttcgattcgatccattcccaagttcccaatcccaaccaacccccctcgaacctccgtcagtctcagtttctccttgctctttcggtcgcaagcaatccacagcgcttccagcgagacgaagagaggagagagaggggaggaagggcccgagagggaggctccaggggccctgcattgcgtagggcgcagccgccgggatggatcacggcggcgagggccgcgttgcggcggctcggcgcacgctgcgtgccggtgtggacaagtcgcgcgctctgggccactcgctggcccgcgcggggccccgtctagaggagatccaggcggcgctgctggcgctggaggccgcggtgcgcccaatccgcgcgccgcatgccgagctcgccgccgcggggccccacatcgaccgcgccgtaagccccgccgccgccgtgctcaaggtgttcgacgccgtgcacggcctcgagccgccgctcctggcgccaggcgccgcgggctcgggcgcggccggggacctgccggggtatctcgccgtcctggcgcagctcgaggaggcgcacaggttcctcgccgataactgcgggctcgccgcgcagtggctcgccgacatcgtcgagtacctcggcgaccgcgacctcgccgaccagcgcttcctcgccgacctcggggtcacgctcgacgagctcaggacaccccccgccggcgacctcgacggcgggctcctggcagccgccctcagtatgctcgaggccgagttccgccgcctcctcgccgaccactccgcgccgctcgcgatgccgcagaccggcgccgccgctggatcggccacgccttcccgcgtgcctgccgtcgccgtccacaagctcaccctcatcctcgatcgcctcgtggccaacggcaggcaagacagctgcgtggcctcttatatcgatgcgcgcgggggtgtggtcagtgcaagtcttcgtgctctcggcctcgactacctgcgcgacccttctcaggacgcgcaggcattgggacctgctcttgatttgtggaggcggcatttggagtttgtggtgcgccgtctcctcgactcggagcggcagctctgtgccaaggtgtttgggcagcataaggatgtcgcgtccgcgtgctttgcagaggtggcggcacaagccggggttcttgacttcttgaggtttggccgcgcggttgctgatgccaagaaggaccccatcaagctccagcgtctgctggaggtgtttgattctctgaataagctgagactggacttcaacaggttgttcggtggcaaagcgtgcgcggagattcagagccagacaagggaccttgtcaagttgttgatagacggcgccgtcgagatctttgaggagttgattgtgcaggtggagctgcagcggcacatgcctcccccagttgatggaggcgtgccgcgcttagttacctttgtcgttgagtactgcaaccgactgcttggtgagcaatacaggcctgtgcttgggcaggcgctaactatccatcgcagctggcgcaaggaggcgttcaatgacaggatgcttgttgacgcggtgctaaacatcgtcaaggcccttgaagctaacttcgatgtttggtccaaggcatatgacaacgctacgctgtcgtatctcttcatgatgaatacccattggcatttcttcaggcatctgaaggctactaagctaggagaggtcttgggtgatgtgtggctgcgagagcatgaacaatacaaggaatactatttgtcaatgttcatcagggagagctggggagcactttcagcgctactgaaccgggagggattaatattgttctccaagggccgggccactgcaagggacctggtgaagcagcgcctcaaaacattcaattcgagctttgatgagatgcatcgcaggcaatcgtcgtgggttataccagacaaggatctgcgggagaggacatgtaatcttgtggtgcagactatcgtccctacctaccggagctacatgcagaactatgggccacttgtggagcaagagggaaatgccagcaagtatgtaaggtacactgtcgatggtttggagaagatgctcagtgccctctacatgccccggcccaggagggctgggagcttccagatcaagcactcgagcggtaagattgccagtgcaatgactggcttgcatcggagtgcttctgcagtgaaatagcctatgttaaagaacccaaagattggatcaatatgatagtatgtggcaattggcaaatgattcatttggcccagtcaagcaaagagtcccgcactggataggtgaccgaataatggacccatggtcggagcagtggtgtcaagtgtcatatgaacataagttactctttagttagcatggagaatagaggctggtgatcagttccgtagctcctgttagtgtccctgaacataagttacccatggtctgagatgttaccattctcctgagctattttctcttgttgtgtacttctgctggtgtccctggcaccataatcattcatctggagatattcaatcagctgtgtagttatgtaaaatcgatttgtaattttagttttaggtgacctgtgggcattaccttttaatgtaccaagaatcgagcttaatagatgcaatggattatatggggggggggaaaaaac

SEQ ID NO: 53 - DNA, 1698 bp, Zea Mays
ctgcgcgacccttctcaggacgcgcaggcattgggacctgctcttgatttgtggaggcggcatttggagtttgtggtgcgccgtctcctcgactcggagcggcagctctgtgccaaggtgtttgggcagcataaggatgtcgcgtccgcgtgctttgcagaggtggcggcacaagccggggttcttgacttcttgaggttgttcggtggcaaagcgtgcgcggagattcagagccagacaagggaccttgtcaagttgttgatagacggcgccgtcgagatctttgaggagttgattgtgcaggtggagctgcagcggcacatgcctcccccagttgatggaggcgtgccgcgcttagttacctttgtcgttgagtactgcaaccgactgcttggtgagcaatacaggcctgtgcttgggcaggcgctaactatccatcgcagctggcgcaaggaggcgttcaatgacaggatgcttgttgacgcggtgctaaacatcgtcaaggcccttgaagctaacttcgatgtttggtccaaggcatatgacaacgctacgctgtcgtatctcttcatgatgaatacccattggcatttcttcaggcatctgaaggctactaagctaggagaggtcttgggtgatgtgtggctgcgagagcatgaacaatacaaggaatactatttgtcaatgttcatcagggagagctggggagcactttcagcgctactgaaccgggagggattaatattgttctccaagggccgggccactgcaagggacctggtgaagcagcgcctcaaaacattcaattcgagctttgatgagatgcatcgcaggcaatcgtcgtgggttataccagacaaggatctgcgggagaggacatgtaatcttgtggtgcagactatcgtccctacctaccggagctacatgcagaactatgggccacttgtggagcaagagggaaatgccagcaagtatgtaaggtacactgtcgatggtttggagaagatgctcagtgccctctacatgccccggcccaggagggctgggagcttccagatcaagcactcgagcggtaagattgccagtgcaatgactggcttgcatcggagtgcttctgcagtgaaatagcctatgttaaagaacccaaagattggatcaatatgatagtatgtggcaattggcaaatgattcatttggcccagtcaagcaaagagtcccgcactggataggtgaccgaataatggacccatggtcggagcagtggtgtcaagtgtcatatgaacataagttactctttagttagcatggagaatagaggctggtgatcagttccgtagctcctgttagtgtccctgaacataagttacccatggtctgagatgttaccattctcctgagctattttctcttgttgtgtacttctgctggtgtccctggcaccataatcattcatctggagatattcaatcagctgtgtagttatgtaaaatcgatttgtaattttagttttaggtgacctgtgggcattaccttttaatgtaccaagaatcgagcttaatagatgcaatggattatatggggggggggaaaaaactagacccctcgagcgagtgaggatgtgctatttgtttggtaaactagagcagatatgtacccccaatacaattgcattacatttactgaaagtacaacttgatc

SEQ ID NO: 54 - DNA, 345 bp, Zea Mays
atgccgggggagtggtccgtggggctctgcgactgcttcggggatcttcacacctcgtgctgcatgagtggcacactgtactacctgctgtcgacgataggctggcagtggctgtacggctgcgccaagcgctcctccatgcggtcgcagtacagcctgcgagagtccccctgcatggactgctgcgtccacttctggtgcggcccctgcgcgctctgccaggagtacacggagctccagaaacgcggcttccacatggccaaaggatgggaagggagcaacaaggtggtggggtgcttccatgggatgacgacgccaccaaggaagcaatccatgtgcttttag

SEQ ID NO: 55 - DNA, 1269 bp, Zea Mays
acggttatttcgtatcagcaatagcatacgccccacgtccccacgcggccacgccttctttcctctctgcccccaccacgaaactccacgacgacgcgtccgcgcaccaggcaggcacgaccaccaccgtggcaccgtccaccggagccgagcaacgcgaggagttgagccgatggaggtggcgtcgggggatgaggatctggaatcgctgctccagaacttccatcgcgtgtcccaggggtacaaagatgcacttatgcaggtccaggttttaagagtaaattgcagcactgagttcaaaaggcgggaagctcttgaatcacatattacagatcttaagaaagataatgagcggttaagaaggcaatacacagaaactttattcaaggtcaccaaccaggtgaaattccgcgcagaagctcaaagcctgaaggaagagctggacaaggcaaatagtagattgttatccatggaagaggaacacaagagggaaactgagcaacttaagcacagcagtgaaatgaacatcaatgccctggagaacaagctcagccacgcccttgtacagcaagcaagagatgaagctgcaatgaagcaactgaagttggagctgagtgcccataaatctcacatcgacatgttaggtagcaggttggagcaggttactaatgacgtgcattcgcagtataaaaatgagatccaggatttgagggatgtggtttctgttgaacaagaggagaaaaaggacattcacaggaagcttcagaatgtggaaaacgagttgaggatcacgaggatgaagcaggcggagcagcaaagggattctgtctcggtccagcacgtggagacgctgaagcagaaggtcatgaggctccggaaggagaacgagtccctgaagaggaggctggcgagctctgaagtctgaactggagtgcacatgaaaactgcaactgctttccttcacgccgtagttttatctcatactgtaggatgtagaaaaatccactgctccaaaaacacatatcacttccagatgctttaaaactagcaatgataggtatgttttcactgaaagttattatcaccaatcgacacactcataaccttttcatatgaaattatataaagataaactctatgtccaagatatagagttcaaagaactttttagttgacaacattttcatataagacaatttggatgttcgaatattcaatataaagatcacatgcctattaaactatcttgggtaaaaaatataatcaaca

SEQ ID NO: 56 - DNA, 907 bp, Zea Mays
acggttatttcgtatcagcaatagcatacgccccacgtccccacgcggccacgccttctttcctctctgcccccaccacgaaactccacgacgacgcgtccgcgcaccaggcaggcacgaccaccaccgtggcaccgtccaccggagccgagcaacgcgaggagttgagccgatggaggtggcgtcgggggatgaggatctggaatcgctgctccagaacttccatcgcgtgtcccaggggtacaaagatgcacttatgcaggtccaggttttaagagtaaattgcagcactgagttcaaaaggcgggaagctcttgaatcacatattacagatcttaagaaagataatgagcggttaagaaggcaatacacagaaactttattcaaggtcaccaaccaggtgaaattccgcgcagaagctcaaagcctgaaggaagagctggacaaggcaaatagtagattgttatccatggaagaggaacacaagagggaaactgagcaacttaagcacagcagtgaaatgaacatcaatgccctggagaacaagctcagccacgcccttgtacagcaagcaagagatgaagctgcaatgaagcaactgaagttggagctgagtgcccataaatctcacatcgacatgttaggtagcaggttggagcaggttactaatgacgtgcattcgcagtataaaaatgagatccaggatttgagggatgtggtttctgttgaacaagaggagaaaaaggacattcacaggaagcttcagaatgtggaaaacgagtgtatgttcgagctgaattggtgaactgaaaaaaaaaagaagatgagtttctgcaaacagcagacgtcatgaaccaattcaaacaggaaaacaaaaacatgattcgtatccccaacatgcttatta

SEQ ID NO: 57 - DNA, 1747 bp, Zea Mays
gtttattttcacttagaaaaatagaaatcacttggtgaaataaggttccaaactagaacttaaaaaaatagagttctaaaactagccctgaccctgattattgaatgaccattgtaccggtaaccatttataatcgtacacccaaaagaatcagacagatacccgttcacccctcgctctcgctgccacttctcccgttcggcctctttttccttccaccaatggaagctctcacagcccgctcctccgtactctcgccgccggggattgccggagacacctcgccctcccttcccctgcccctccgccgagcctccgccgcgtttcttgggcctcgcaggagcccctccgccctcgccatctccacgcgctggctgcgcgctccgcctcgacgcggcggccgcctgctcgcgggggaaggggaagaagtgccccccgaccccgccgatgacgcggctggccgggcggaagattttctagtactcgagaataatgtaactctacgccaaagcaatgacatggataccattaaacatgatgatgctggcacttctggaattggtgggagtaacactggtggctctaggactggcctattcagaacacctatttcaggtggtgtgcacagtgcaactgctgttcatgatttaccaccaccagctttggctgttcgcaacctcatggaacaggcaaggtttgctcatctgtgcactgtaatgtctcggatgcatcaccgccgtgagggatacccattcggttccctagtagattttgcacctgacccatttggccacccgatcttctcattatccccactagctatccacacaagaaatttgttggcagacccaagatgcacccttgttgtacaggttcctggatggagtgggctatcaaatgcacgagtaactatctttggcgatgtcattccgttgcccactgaacaacaggaatgggctcatcagcagtatgtttcaaagcaccagcagtgggcatcccaacagtggggtaacttttactattacagaatgcacacaataagtgacatatatttcattggaggttttggtactgttgcttgggtagatgtgaacgaatatgaggctctgcaacctgacaagattgctatggatggaggggaacaaaatctgaaggaactcaacgcaatgttctcaaagcctctgaaagagcttttgtcaactgatgaaggagaggtagacgatgttgctcttatttcaatggacagcaaaggtatcgatatccgtgtccgacaaggtgcacagttcaacatacagagggtgccctttgaggtggatcacagcgtcgaaacactggatgaagccactgaagcgctcaggaggataatcagcaagtctaggtggcacacaaagagctcagtcataggacgcccttgaaagctgaagctggaggctctatagaacagtttgtacagtgcggcagcagtctctactatggtatgtgccaataagaggaactccgttccagagtttcgtctactgccaagggcctcgtgtttgtgggtgggttgaataaacacgcaatttgagatgacgctgttttgaccatgaatttagattgaacgcacaacggcaaaaaggattttatgtgaagttgtcgatgggttgaaaaagatgtgaccatctctgacggtctgacctgcttcattcatgaggaattgaggataaagcacatttgaacatgcgcatgccattttgtttttaccaaa

SEQ ID NO: 58 - DNA, 1003 bp, Zea Mays
gtttattttcacttagaaaaatagaaatcacttggtgaaataaggttccaaactagaacttaaaaaaatagagttctaaaactagccctgaccctgattattgaatgaccattgtaccggtaaccatttataatcgtacacccaaaagaatcagacagatacccgttcacccctcgctctcgctgccacttctcccgttcggcctctttttccttccaccaatggaagctctcacagcccgctcctccgtactctcgccgccggggattgccggagacacctcgccctcccttcccctgcccctccgccgagcctccgccgcgtttcttgggcctcgcaggagcccctccgccctcgccatctccacgcgctggctgcgcgctccgcctcgacgcggcggccgcctgctcgcgggggaaggggaagaagtgccccccgaccccgccgatgacgcggctggccgggcggaagattttctagtactcgagaataatgtaactctacgccaaagcaatgacatggataccattaaacatgatgatgctggcacttctggaattggtgggagtaacactggtggctctaggactggcctattcagaacacctatttcaggtggtgtgcacagtgcaactgctgttcatgatttaccaccaccagctttggctgttcgcaacctcatggaacaggcaaggtttgctcatctgtgcactgtaatgtctcggatgcatcaccgccgtgagggatacccattcggttccctagtagattttgcacctgacccatttggccacccgatcttctcattatccccactagctatccacacaagaaatttgttggcagacccaagatgcacccttgttgtacaggttcctggatggagtgggctatcaaatgcacgagtaactatctttggcgatgtcattccgttgcccactgaacaacaggtttgcactaaaatcactactgatgttatctcttttcctgaataccatctctc

SEQ ID NO: 59 - DNA, 910 bp, Zea Mays
gtttattttcacttagaaaaatagaaatcacttggtgaaataaggttccaaactagaacttaaaaaaatagagttctaaaactagccctgaccctgattattgaatgaccattgtaccggtaaccatttataatcgtacacccaaaagaatcagacagatacccgttcacccctcgctctcgctgccacttctcccgttcggcctctttttccttccaccaatggaagctctcacagcccgctcctccgtactctcgccgccggggattgccggagacacctcgccctcccttcccctgcccctccgccgagcctccgccgcgtttcttgggcctcgcaggagcccctccgccctcgccatctccacgcgctggctgcgcgctccgcctcgacgcggcggccgcctgctcgcgggggaaggggaagaagtgccccccgaccccgccgatgacgcggctggccgggcggaagattttctagtactcgagaataatgtaactctacgccaaagcaatgacatggataccattaaacatgatgatgctggcacttctggaattggtgggagtaacactggtggctctaggactggcctattcagaacacctatttcaggtggtgtgcacagtgcaactgctgttcatgatttaccaccaccagctttggctgttcgcaacctcatggaacaggcaaggtttgctcatctgtgcactgtaatgtctcggatgcatcaccgccgtgagggatacccattcggttccctagtagattttgcacctgacccatttggccgtaagtaattttaatatcacatcttgtacctaccaagtttctagattgattttttatttatttattgcatttttgtcatgaagacccgatcttctcattatccccactagctatccac

SEQ ID NO: 60 - DNA, 8129 bp, Zea Mays
cccgagcgcgcgactccctcccgcctcccagatcttccagaacccgctacgattcgggcaatccgccggcccgcgccctagtaggtctccgcgggcgggattggttgatgcctccccgcctcgcgtgaccgctgcccgagggctggaccggagatctccgcatggatcacaggggcggcggcggcggtggcggaaacaagaaccgcaccgatctcctcgctgcagggcggaagaagctgcagcagttccggaagaagaaggggaagcggggtcccggcaataaggccgacgccgatgctgacgcggaggccggggagggggcgcccaaggcggcggaggagtctgtgcccgagccgaaatcgcctgttgggttgaagctcctcgccggggagggcggcggcgggagcactccatttgaggaagcggagaggtctcaggcggagcagtgcaacggtgaggggcctggtaccgcggagtccagctctgtggagagttccaatgcggtgcaagaacaggagacggtgcaagagcaggagacggatgatgtctccgatgcacatcatgtcggtcctagtgagcaggggatttcggagcatcctgaaagccagacagctggtggcagggatctatcacttcaggctaccagtggagacagcattggtgatgataatgtaggacgagctcagctgggtgatgtggatagcatggagctgaatgcttcttctgaaggtaatggagcagatggtgattgcaatcaactaggggaacaccagcaggtggaaatggatgctgttgaaaggccaacaagttccagtttcgaagaattcaccgagttgccaattcattctcaaggcattgaagccgataatatccacggtgaaggggctcaggaaatggtgatggatgtttctgggaggccattagatggagacatacagcatgacatcgagcccacagcttctgctgaaatagatgccgagactgcacttgaagagtcaactgttgcagcttcaattgtgattcctgagagtactgcaagaggtactgagtacgaaagagacactgggtatgaaaccgatggagtagacaaagaggctctcctagaagatccaagcatggtgcatgtaagtgatgaagctgtcactatagatgatttgagtgttcaggccaagccaacagcatcagcggatatgccactttgtgagcagaagggggatccagctttatctagaagtgcggtattgcaaggcattatgccacttcacttcgaggatatacaaaatcatatgttctctgcaactctgtcaagggattttctccagttgcagctagatgaggctgctggcctttattcagattttacacaacagtcttctgacaataccacacagctccgggtactgctaaaagaaactgaagaaagcaaactagcagttgacagagagcttcatcaatgtagacatgagctctccaaggtgaacatagaaaaggggcaacttgaactgaccatggcttccttgaaagaagaaatcaacactagcaacacgaggtgcacatatttggagagtgagctacattcctccaaggagagcacagaacaaatccacagtgaactagctaacagcagattgttactggaagctctgcaaaaagagaacatggagcttactgcaagccttgcttttgagaaagaagccaaaaaagaagttgaagaacagcgggaccatctatcttctgataacaggaagcttttatcggagttgtcaggtcttgagcttagcttagcttctgtgaaagaggaaatggatgctagcagtagcagatgtaatgtttttgagtgtgagctgcgttcctccaatgagaatatgaatcatactttgacagagttggcaaattgccaggctttattggaaacattacagaaagataatttggagctgtctgcaaattctgcctccgaaagagaagcaaaaatgaaactccaagaagacaatttgtatctatgtaatgaaaagggcaagctttcttcaaatttacgtgaactaaatgacaagttggaagtttcgtatgccaagcataagcagcttgagtcacatgtcaaagatacagaaacatactttggacaacttaccgagcagctaattgaggaaaatctgtacacaagtattagcatcgatatttaccaatctacaaccaaagacttagacactaagtacaatattgtgctgggacaattccagaatattatgcgtcaagaacttcatttggactcgtctgaagtcactactgagaatgctgaaagagccattatgacccctagacatgatagccatggtaataatcagtgtttgcttaatctggtaaatgcgaatgactcatgtaactcaactgctttgctgtcgctgaagggccatctagaggtggcaaaaagtgatttgcataaccttgaaaagttgctagagaggatctcctctaggtctgatggacgtgttctggtatcaaaactcattaaatcctttgagtcaaagggaagtgacgatgatactggactgtctgagggggagcatgataatttacaaaagtcaactcgggagatgctatcatgcctaggggagaagtttatagcaatgagctcagatattacaaaaactgaagaatatttggctgaactgtgtaacaaaattgaactttacgtcaagtctactgtgcagcatgatagagatagacaatgtactgttgttcttgaggccaaaatggatgaacttgctggcaagctgagcaactacaaggagacaattgacaatctgcacaatcaggttgctattgtgcagcaggatgcaaacagtaatgctggaaagctcattgatcaagcagaactgttgcagaaggatgcggtagaaaggatttccattcttgagaatgagagaatgtctttatcagatttactcagtgaagtaacaaacaagctcacctctttgggagatgctgtatttcctagtggttccagtgaaattgaaggtctcaatttctgcactttgagctgtgtggaccttgttgctagatcatttcaaagtcttcaggagaaattagaggctgctcaaatagataatgctcagctcaatagttctctggtggagctcaggaaggcaattggtgttgctcaagagaggagtgaacatgcagatggaattgtcaagaaactgtatgattccctacaggaacttctatgtgattcacttggaagttcaaatgaatttggggccagatatagtgttgaggaaccaattgaaagtcaatatggaagactcattgcgcatttaaagaatttgttgcatgaccaccattccgcgctgtcaactaatgctgaacttgagttgagtctgttaagtaaatgtgaagaagttgaggagctcaacatgagatgcagttctctattaaaaaaattggatgaagtttgtattctaaatgaggagcttaagtcagcttcttcaagtaaaaacgtcacactggataaactacacagtagatgccttactgtagcagaaatgttggcttcatgctcagcaaatcattcctcgacagttcagttgatatctgatattggtgaaggatctagcaaggaagatcatattcttaccacccttctcccatgcattgaggcggacgtggcttcatgcatcgagaaatttgaaaatgcagctgaagaaatccgtttgtctaagatatgcttgcaagaaatcagcatatttgaccagatttcatttgaaaaatggtcttaccccttgcccacattgattaaagaggaagttttaccaaagatatgtgatttgcaagacagattcgaccagctcaatgcactaaacattcagctggaaactgaagttgcagtcctcaaggatggcatgaaagagctggatgaagatcttggaacttcgcgatctgagcttcagaaaaaggtttctgaacttgaacagttagatcagaaattttcatctgtgaaggaaaaacttagtattgctgttgcaaaaggtaaaggtttgatagtgcagcgtgacagccttaagcagtctttgctggagaagtctggtgagatcgagaaactcacacaagaactgcagttaaaggaaacattgctgaaagagttggaagccaaactcaaatcctatacagaagcagatcgaattgaagccttggaatcggagctgtcatacataaggaattcagctacagctctaagggattcatttcttctaaaagactctgttcttcagagaattgaagaggtcttagaagaactagatttgccagagcaatttcattctcgagatattgttgaaaaaatagaactgctgtcaaagatggccattggcactcctttcactctacctgatggtgataagggatcctctgttgatgggcattctgagtctggtgtggctatgaatgtcatagacgatgagcagaactcaaattcaaattcagtatctgatgaagtaaagagcaaatatgaggaactgaataggagattctgtgagctggctgaacagaacaatatgctggaacaatctctagtggagaggaacagtcttatacagaaatgggaagaagtccttggccaaattagcatccccccacagttcaggatgttggaagcagaagataagttagcatggttaggaaacagattcttggaggtggaacaggagagagattcattacagttgaagattgagcatcttgaggattcctcagaaatgcttattgctgatctagaagagtcacataaaaggatatctgaactcagtgcagaggtggttgctataaaggctgagaaggatttcttttcacaaagcctagagaaactgagatttgagttccttgggctctctgagaaagttgttcaagatgagtttgttagagataaattgcgaatggatctatctgaactgcgggataagttcgctgaaaaaaccgaggagagcaggcactaccatgaaatggacaccgaggtccacaaactgctgaatttggtgcaaaacacattgcaggatagcactaactctgaaatttcatctggaggcatttctgctgtgttgtgcttgggcaaaatgctgaagaaacttttagatgactatggcactcttctgtacaagtcgactgaaggcaattttgccgagagagacattcagttagaggatatcaagccatctaaggatgcctctaaatcggacactggtgcatacgagaaagagatggaactaaattctttaaataacgagttagatcatgctcacaacaatctggccttagcgcaacaggagtgtgatgaagctgtggagaaggcacaatcactaatgatggaaattgagaccttacatgctcaaataagtaaattgcaggaaagtgatgctgaacaaatgcaaaagaaagagatggaactaaattctttaaataacgagttagatcatgctcgtaacaatctggccttagtggagcaggagcgtgatgaagctgtggagaaggcacaatcactaatgatggaaattgagaccttacatgctcaaataagtaaattgcaggaaagtgatgctgaacagatgcaaaaatatcagtcgcttgtccttgaactagaaagtgtgggtaagcaacgggacaatctacaggagcggttaaatcaggaggagcaaaagtgtgcctcattgagggagaaactaaatgttgctgtcagaaaagggaagggtctagtgcaacacagagacagcttgaagcaaactatggaagagatgaatgtagtgatagagaaacttaaaagtgaaagaaaacagcacatagaatcacttgagaccgagaaatcatcgttaatggatcgattggctgagaatgaaaagagcttgcatgaaacaaaccagtacttgagtggactattaaatgctttaaatagagtggatgttgctcgggaatttgatatggatccaatcaccaaggttgaaaagatggctaaatttttccttgacctacagtcaacagtggcttcatcgcaaaacgaagtgatgaaatcaaaacgagcaacagagctgcttcttgctgagttaaatgaagctcatgaaagggctgacaacctgcaggaggaattggtcaaggcagaagctgcactttctgaatcttctaaacaatacattgttacagaatctgcaagagctgatgctgttcgtcagcttgaacttattatgcatgcacagtcacaaacaaggaggaggcaagcagatcatttgctggagttaaactccaccagcagtcaactaagagaagtctgctttgaactttcacactgtcttgttaatacattcagtaaggatgtggaccttatctgctatgtggtgaacttcatgaggtcttctggtaaattgatggatgacacaaatacgatggacataccgattgcctctaaacatgttttgtccaaccgcacaaacaacaagaaggctcatattccaaatgctcctttggaaattaagacggatgatacggatgacagtcagtttttgcatcatcttgctattgcatgccatgctttatctgattgtgttaaggactgtaatgatctcaaaagaaacattgatgagcatgacttttcagttgaacagaaagcaaccgagctatttgatgttatgtccaccttaaagaataggttcacttctcagcataatgagttggaatctttgagagcaaaatttgttgaactacagtcagagatggaagaaagagacaaggagattatatttgcacaaaggaatatgagcttgctatatgaagcatgcgcaagttcagttgctgagattgaaggaattagtgatatatatcctggtaaacacagctatgctgttgaacattctgcagatgaatgtataaaatcaatcgttgaacagttagttatggctgtaaaaacttctcagaacagtaacgaaggtagcacaaaggagctgaaggctattgttcttgagttgcagcaggagcttcaagctaaagatgtccaaattagcacaatcagttctgatctatcatatcagttaagggtggctgaatcttctgcaaagcagttctcagttgatcttgaagatgcaagaatggagctccaaaatttggagaaacaagttgatgtgttgcagaatcagaagaaggatttagagactcaattaaatgagcttaaaaatatggaatcaatggcaagtgaacaacatggaagaattgagaaattgactgatgaattaagcagaaaagatcaagaaattgaaggtttggtgcaagcactcgatgaagaagaaaaagagcttgaaatcttggagaataaaagccttcagttggagcaaatgctgcaagagaaagaatttgccttgaagacctcagaagtttctaggaccaaagctttggcaaaacttgcaacgactgttgacaaatttgatgagctgcatagcttgtctgagaaccttcttgctgaagtggaaaaccttcagttgcaattgcaagaaagagattctgagatctcatttctgcgaaaagaagttacaaaaagcactaatgaactgctaaccactgaagagagcaacaaaaattattcatctcagctaaatggtttcatgaagtggttagaaagagaactgttgcagttcggcttccattctgagagtgccaatgattatgattacactcaatttcctgtctatatggatatgttggacaaaaaaataggatctctgatagccgaatcagatgatttaagggttacagttcaaagcaaagattctttactacaggttgagagggccaaaattgaggagttgatgcgtaaatcagatggtctagaagcttcattgagccaaaaggattcccagatagggttacttcgccgggacagagcatccaatcagcagagcagatctataaatttgcctggcacttcagagattgagcaaatgaatgacaaagtaagcccagctgcagttgtcactcagattcgaggcgcacgaaaagtcatcaatgaccaagttgctattgatgtagagatggagaaggacaagccttttgatgatgaagatgatgacaaagggtctcaggcgatagattgctcatga

SEQ ID NO: 61 - DNA, 1313 bp, Zea Mays; identical to SEQ ID NO: 51

SEQ ID NO: 62 - DNA, 1349 bp, Zea Mays
cagtaataatgaaaatgggcggttcatttatggagttgcgagttctcctggtaaaagagcatcgatggaggacttctatgaggcaagaatagacgacgttgatggagagaaaattggaatgttcggtgtatatgatggtcatggaggagtccgagcagctgagtatgttaagcagcaccttttcagcaatttaatcaaacacccaaagttcatcactgataccaaggctgctatcgccgaaacttacaacctcacagattcagaatttctgaaagctgatagctgtcaaactcgagatgctggctcaactgcctcaacagctattattgtaggtgaccgtttgcttgttgcaaatgttggagattctagagccgttatttctaaaggaggacaagcgattgcggtttcaagggatcacaaacctgatcagacagatgagagacaaagaattgaggacgcagggggctttgttatgtgggctgggacatggcgagtgggtggtgttcttgctgtctctcgcgcatttggtgataaactcttgaagcagtatgttgtcgctgaccctgaaatcaaggaggaggtggtcgacagctcccttgaattcctcatccttgctagtgatggactctgggatgttgtcactaatgaggaagctgttgccatggtcaagcctattcaggacccccaggaagcagcaaacaagcttctcgaagaagcgtcccgaaggggaagctctgataacatcaccgttgtcatcgtccgcttcctatatggaactaccggtgataaatcaggcgcagacaaagagaccaccaatgaccaaaactcctaattacctcctgtagggatccctcatgcgtgtgttttcttctggctgttgtatctgatgctcaaagtagatgctccgtgtgtcttccgctgctgttccgcaaggaaactgactcccccgaccgtcgtcgtgatgctgcccgctcatgctcctagacgggaatgactgccgcagaatgacgaatagggctggtgtgtgttacagtatggtcctttacccctcctttccattaagctctgtgatgtagctgtccgtgctgttgattcatgagatcatgctagagatttttcctggcagtgcgtgtaaaactgtcgaactatttgaacgaaagttgtacactgcagtatgtaacaatctcctagatccgccttttgtggcgtcctgctgtcatgcacctgaatgctaccaagccgggacggaggtgagctatcggtttactcggtgtacagaaacgggaaggtcgaatttttacagagcaagtgcgtggattatcatattaatgtgcaaataaactgttaca

SEQ ID NO: 63 - DNA, 1562 bp, Zea Mays
cagtaataatgaaaatgggcggttcatttatggagttgcgagttctcctggtaaaagagcatcgatggaggacttctatgaggcaagaatagacgacgttgatggagagaaaattggaatgttcggtgtatatgatggtcatggaggagtccgagcagctgagtatgttaagcagcaccttttcagcaatttaatcaaacacccaaagttcatcactgataccaaggctgctatcgccgaaacttacaacctcacagattcagaatttctgaaagctgatagctgtcaaactcgagatgctggctcaactgcctcaacagctattattgtaggtgaccgtttgcttgttgcaaatgttggagattctagagccgttatttctaaaggaggacaaggtaagtttctcgttggtaacatgacatatctcaatgtcttttcctatacttccacatgtatcggaaactttcaaattattatatgctgtgtattttcctggacgagtatttccttgtgacgaatggataaactgaatatcaggattccaagctaaccacgttccacttgtattcgatattttttgttatgttttccccatctcggagctgcagcgattgcggtttcaagggatcacaaacctgatcagacagatgagagacaaagaattgaggacgcagggggctttgttatgtgggctgggacatggcgagtgggtggtgttcttgctgtctctcgcgcatttggtgataaactcttgaagcagtatgttgtcgctgaccctgaaatcaaggaggaggtggtcgacagctcccttgaattcctcatccttgctagtgatggactctgggatgttgtcactaatgaggaagctgttgccatggtcaagcctattcaggacccccaggaagcagcaaacaagcttctcgaagaagcgtcccgaaggggaagctctgataacatcaccgttgtcatcgtccgcttcctatatggaactaccggtgataaatcaggcgcagacaaagagaccaccaatgaccaaaactcctaattacctcctgtagggatccctcatgcgtgtgttttcttctggctgttgtatctgatgctcaaagtagatgctccgtgtgtcttccgctgctgttccgcaaggaaactgactcccccgaccgtcgtcgtgatgctgcccgctcatgctcctagacgggaatgactgccgcagaatgacgaatagggctggtgtgtgttacagtatggtcctttacccctcctttccattaagctctgtgatgtagctgtccgtgctgttgattcatgagatcatgctagagatttttcctggcagtgcgtgtaaaactgtcgaactatttgaacgaaagttgtacactgcagtatgtaacaatctcctagatccgccttttgtggcgtcctgctgtcatgcacctgaatgctaccaagccgggacggaggtgagctatcggtttactcggtgtacagaaacgggaaggtcgaatttttacagagcaagtgcgtggattatcatattaatgtgcaaataaactgttaca

SEQ ID NO: 64 - DNA, 917 bp, Zea Mays
atatgtgccattactgttgcttctactgcttgatttttcgaaatttgtagggacatggcgagtgggtggtgttcttgctgtctctcgcgcatttggtgataaactcttgaagcagtatgttgtcgctgaccctgaaatcaaggaggaggtggtcgacagctcccttgaattcctcatccttgctagtgatggactctgggatgttgtcactaatgaggaagctgttgccatggtcaagcctattcaggacccccaggaagcagcaaacaagcttctcgaagaagcgtcccgaaggggaagctctgataacatcaccgttgtcatcgtccgcttcctatatggaactaccggtgataaatcaggcgcagacaaagagaccaccaatgaccaaaactcctaattacctcctgtagggatccctcatgcgtgtgttttcttctggctgttgtatctgatgctcaaagtagatgctccgtgtgtcttccgctgctgttccgcaaggaaactgactcccccgaccgtcgtcgtgatgctgcccgctcatgctcctagacgggaatgactgccgcagaatgacgaatagggctggtgtgtgttacagtatggtcctttacccctcctttccattaagctctgtgatgtagctgtccgtgctgttgattcatgagatcatgctagagatttttcctggcagtgcgtgtaaaactgtcgaactatttgaacgaaagttgtacactgcagtatgtaacaatctcctagatccgccttttgtggcgtcctgctgtcatgcacctgaatgctaccaagccgggacggaggtgagctatcggtttactcggtgtacagaaacgggaaggtcgaatttttacagagcaagtgcgtggattatcatattaatgtgcaaataaactgttaca

SEQ ID NO: 65 - DNA, 303 bp, Zea Mays
atgaggaggcgacggtgggcgccgctcgccgccgcgtgcctcgtcgcgctcgcggcgctcctggccgccgtccacggcggcggcggtggcggcgctcggggcgccgccgcgccaatgcccgcgacccgccgcccggaggcgagcgcgcgcgtcgccgccttcgacgccgcgcggtgcaagaggcagcggaacagagctggcgccgcctgcgcgatgctgcccgccgccgctgcggccggcggcggcggcgacgacgacaagcgggtcgtgccgacaggctccaaccccctgcacaaccgatga

SEQ ID NO: 66 - DNA, 575 bp, Zea Mays
gtcattcgtgggcattggtaatatcaccacacgctctcggagtcccgctgtgatcccgcccgctggctcgactttgtccctgggtgcatgtgattcatgaatatcctgcatgtctgttcagttcatctccgtacgagacacgaattgctgagtgcaggtctgttcatgccaaaatcgtacaggaatgagagggtagagctgataagcataatacatgtacggatttatgctcggatgtggagacaagagaaagtggtttggggagcattgagctatcttcatgagattcagcctattcaggtcatgtactcatgtggcacagcctagaggaccaactgaccaagaatactaaagcacataggatgtttagttttctgattttaatttttgattttctatccaaatatagactctttagtatgacacccttgcattggtttctttgataacatactagacatggatgactactgaatatgttattatagtgcggagaatctaactgtatgatcattatgaaacctatgagtgatcatcttacaaagaacaagatatttaagcatcatgtttccatc

SEQ ID NO: 67 - DNA, 984 bp, Zea Mays
atggcgtcgtcgcggtccctgccgcggagcgcaagcgagctgcccgacccgccgtcgccgttcagctccaacccggcgcaccacccagtctccattccgaccacgcccgggctctcgtcgtcgtcgtgctcgtcgttcggccgcatgcggtcaccgcccaccgactcgccgccgatcacgcccaccaagcagcagggcggcaagcccaagccgacgccggcggccgccgccgccgcgtactacgcgtcgctgtggtcgcccaggcgcctcatgcagcgctgtgcccgcgccttccgccgcagcaggtcacgcggcggtgtcgttaggacggtcaaggacctcgccgaggaacgggcggcggtgctcgccgccagcagcaaggtctccgacgcggcgtcggcggtgccgccgctgcctcctggtgtcgagaccgccagcagcaacggtgcccgcggcggcagcgtggaggataagcagcggcagcgccacgacgactgccaccccgaggtcgttcccgagaagatcatacgggaggacgcgccgccagttgttgcggagaccgctgccgccaccaccaccacggaggtggaggtggaggtggagtcccccaagaaaggagcggcgccggtgccagagcccatcgtcgttgtcgccgcagtggaggacgtggtggcggacaagttcgtggcggtggtgaaggaggcgatcaagaagccggagatggacgagaaggaggtggcgatgcggagattcctgggcagccgggtgaagacagcgatggagccgcggtcagaggcggagcagccgcggcgccgggaggtggcgcggagcaacgacgtgatcgaggcggcacgcaccaagctgatgcagaagcgccagtgcagcagggtcaaggcgctcgtcggcgccttcgagactgtcatagacacccagaaggacgccgccgccggcaggccacaacacatctaccgcaagtcagcttaa

SEQ ID NO: 68 - DNA, 1395 bp, Zea Mays
atggcctcggatccaaccagggaaggaaggaatccaagccaccccagtccgctgcttccattccatctcccttctctcgccttctgcggcactgcagtgctctgctgcctcggcgtctccacctcctcccggcgacggcagggcatccgatacgacgccgcgcttccttccgaatcccaagccgcaccccgcaccctcccggtcgccattcccgatgctggtgttctcgagcgacgacgactgctgcggctcctcgtactaggggggcaggatcgatcggcaggtgacgtttcgttcgttctgctgttcggttcgaacgggagagtttgcttgggggttggtgcatcggtttcagaacgaccagttcattagttttggggattggggctatttcttgttttttttaaggcaggagagttgcttttcattctacgtattcgagagatgaaaaaaaagtgttttttgggctagttttgttccaatgatttggtagcaattaccatggcagttgcacgaaagggattcatgtactgggtctgaacggtttcatggcgatgcagtttccatcaccaaattcaccgtgagatgtctggtactcgttgtgactaactcagtaggcagtctgtcagttaagccaggtaaactagttactagtacttgacattgccactgtattttttgtaattactagtaccatttgatgagaagtggtactgagttttatgtgggtagacgaacgatgtcatcgcactcccttctcagtgtcaacgatcatgggtggcatgacctgtgggctgtggagggcggtcccggtccccttcgtttggcttatctggaaaatgctggttgcgcgtcaaggccatcttgaaccttggaaaaacgctgctgtgtctatctttcctgccttcctggttccgtccgtgctgtgctgacatgcgtgtcgaattctcgctcatttggttaccggtagtggggtcatgtcggatattgatgtggaagggggagttggtagtggcaccccctccgcctcggacctggcttcttctgataccggctctggagctgggtaatagagcgcagactttgggtctggaaagcgattgtggttatcgttacgacaagtatgctaggtcaaaactgtttttgtatgtagttggttcacagatgccaagggccgatttatttgtttgtttgttgctcatgttgatgttctgagcataccatttttcagatgtttatatttcatatctgataaagtttataagtttattgtcgtcattaagatgggttaagaaggatgcctgctgtgttttaggatgaggctccatttggaagtcaatagtgcaacactgctcattccaatgatatacccccactacaaacagacacttggtc

SEQ ID NO: 69 - DNA, 2659 bp, Zea Mays
atggcctcggatccaaccagggaaggaaggaatccaagccaccccagtccgctgcttccattccatctcccttctctcgccttctgcggcactgcagtgctctgctgcctcggcgtctccacctcctcccggcgacggcagggcatccgatacgacgccgcgcttccttccgaatcccaagccgcaccccgcaccctcccggtcgccattcccgatgctggtgttctcgagcgacgacgactgctgcggctcctcgtactaggggggcaggatcgatcggcagactcgcagaactataggatatcacagaacagttcttgaggtacttattgcagcctaatagtacatggagcgatattcagatatgagaccaaaggcagaagtttcatatctcggaaggggttccagattctcttctagaaatcaaagttcagaagagaggactaaccatagcagcgataaaccgggaagcagcacaagattcaatcctacgaaagcgagaattggcggtaatcaagggaggccaagatatgtatgcgattcatttaaatctccaagctcaaaggtgtcgcctgcaggctcttccaaatttccacttagcaagtttgaggagaggcgaagacagccttttgtgccagggtttgacattgctgaaagtagtagaagaaaggctgatgccaagcagctacagggtagtaagaaaattgctgcagagaacgacagttcagacaatctgcgaggtgaatcagaaggttttactactgaacaagtagtaaaaccagaaggctctcatgttgtcggtcattcaggtgtttctgcgtatacagtcgggtccctggtccaaactgcttcactaggttctaggacacacagacagaaacacaaagaagtgaatttgggtactccaggagcatcgtcttcaactctgactaacaggtctactatacctggaaattctaccatgggtgtgaggccagcttatggtcatgttaatggagggcagatacatggtcttaaaaaccttggttgttcttcggtacctgatgctcagccatcaggttgcccatctgagtctgttattagtaggaggaggtttgagttcatgagaaagagggcctttgaccaggaaagctcttccagatcagtgaacttaagcttaggtcattcaactcctacagatattcgcagaatcagaatgaatgaacaatcactttgtcaacaaataccacgaagcagcagcagaagccatcaggaatcggcaggttcagttaggacaagacgaccttctcctcatgccactaggatgagtgttcctgatggaagagcagatggcgtgctttctctgcacgagtcatccacaaaggatgtacagccagctcaggaacatctttcattggaagaagtctccactgagagttcaataaggccattctttgtggaatttgataataacattttctcgtctagtcatcttcgtcgctcgagtactcgagctgaaaggggaagaccaagctccctttttgaagaaagtcctcgacaaatgttccatagtctcatgggggagagggacagacatagacacataaccatggaaggaattacagaggttttggctgcattggagaggattgaacagcaagcagagctgacctatgatcaattgctaatgctggaggctaatctattttttggcgcctttgcctcctatgatcggcatagagacatgcggatggatattgatgatatgtcctatgaggaattattggccctggaggagagaataggctctgtgagcacagctctttcagaggagcagttcacaaaatgcctcaaaagaagcatatatagtcaggtcgctctagaagtgaacaaatcaaccgttgatgacatgaaatgcatcatctgtcaggaagagtacgcggagggcgaagaggttgggaggctgccatgcgagcaccggtaccatgtgtgctgcataggccagtggcttgggcagaagaactggtgtccagtatgcaaagcgtctgccgtgccttccaagggctgaagcattggggatgctggaaaccccgttccggattacaaaccatccttgcttttgtctacgtacattgttcttttccctatatgcattagatatagatcatgtctagatgtatgacgctagaacagcttgcgatttgggaggaagctaagagagtaatagttagctggttaataatagttcatagctaatatttgctagataactattacttggctacctattagctgtgcctttcacattgtggtacaggacaaatgcttgtcagatcgtgaacaaccttataacttgatgaatggcctaagtcaaagaggaatatgttgtgccaatctcaaccctatgctctcttcgtgtagtctgggtgtgtttggttgcgggacagtcaagaaagggacgttccctgacgttctctctcgtctttctgattttgagggataactggggataacactgtaatagttctgtttcaacccttgatcttgaactaaacaaccttatttgagggatcatctcatcttatctcgtcctgtcattacaaccaatcttgttagaaaataaaaaatgcggtagagatggtatcatagtagttgtacataagacagttcaatctattgt

SEQ ID NO: 70 - DNA, 2709 bp, Zea Mays
catctccccaaagtcccaaacgcctcgcctcgccgtcgtcgtccactcgttcgtcgctgctccctcctccaccaccttccagtcctgtccagtgccgccgccttgccctgccctcccctcccttcccccgattaccctcgcggttgacctcgccaatccggtcccgcctccgtataaatccgcccttctcgcccccgctccgaccacaaaccctagcggcgcgccccggcatgggctagggttcccgcggcgatggagtgggacagcgattctgacggcggcgatgacgaggaggaagaagaggtccgccccgggggtggggacgcgggcccggggttctcgctggccatcgagggcgtgctgggcgcgtgcggcatggtggtctccgacgcgctcgagcccgacttccccatcatctacgtcaaccgcgggttcgagagctccactggatacagcgccgaggaggtgcttgggaggaactgccggttcctacaatgcagaggaccatttgctcagaggaggcatccccttgttgatgcagcagttgttactaggattcggagatgtttagatgaagggactgaatttcatggtgatctgttaaattttagaaaagattgttctccatacatggccaggctgcaattaacacccatatacggagacgatgaagtaataacacactatatgggcattcagtttttcaatgattctaatgttgacttggggccatcttctggctctgtgacaaaggaacttgcaagatctacatggattgcacctggcaacactgactcaccaactccagtaggcaagggtaatttgtgggaacattctagtctctttctgctgagtgatgaggtaatttgccagaagatcttgtccaaactgtcgcccagggatatagcatcagtaaactctgtttgcaagcgacttcatcacatgacaaggaatgaagacctttggaggatggtttgtcagaatgcatggggcactgaagctactcgggcccttgagactgtggcaggatcaagaagtttggcatggggccggctagcacgagagttaaccacccttgaagctgttgcctggaggaaattgacagtcggtggtgcagttgagccatctcgctgcaacttcagtgcctgtgccgtagggaaccgtgttgttctatttggtggagagggtgttaacatgcagccgatgaatgatacatttgtgctggacttgagtgccagcaagccagaatggaggcacatcaacgtgagcgcagctcctcctggtcgctggggccataccctgtcatgcctgaatggatcacggctgattctgtttggtggctgtggggggcagggtctgcttaatgacgtcttcattttggatcttgatgcacagcatccaacttggcgtgagattcctggccttgcaccccctgtaccacggtcatggcatagctcctgcactgttgatggaaccaagctggtggtttctggtggatgtgcggactctggtgttcttctcagcgatacctacctcctagatgtgacaatggaaagacctgtttggagggagatacctgcatcttggtctccaccttcaaggctggggcactcgctatctgtctatgatggcaggaaaatcctgatgtttggtggccttgctaaaagtggtcctctacgacttagatctagtgatgtgttcactctagatttaagtgaagacaagccttgctggcggtgcataactggcagcaggatgccaggagctggtaatcctgctggggtcggcccaccacctcgcctcgaccatgttgtcgtgagccttcctggtgggagagttctgatatttggtggttctgtggcgggtcttcactctgcttcaaaactttacctcctggatccaacggaagataagccaacctggaggcttctgaatgttccagggcatcctccacggttcgcctggggccacagtacttgtgttgtcggagggacaaaggcaatagttcttggaggacaaactggagaagagtggacgctaactgaaatacacgagctttctctagcaagctcattagtctgaagatgggaaggtcccagcaagctttccagcttccttgaagcaatgtctctggagacagctacctgttcatatgacttgaggcagattttttttccaacagtggtgtgcaagcacaagcacaaaagggttggtgaagtggacaaccagacctgattacttgtgccatgcctgggagtcagctggtctaaaagtaggaataagttacctctgctgctgctgttcgtatgatctgaaatgatggaatagctggcatccataagctaatctcagttcttatcatgtttcaaatgggacactggcattatgtcgctggagcccctgatgcaacaggtaccctgccttctggttgcgcctgccttcggtgacaactgatgctgtggtcttctgttttttgacccatcaactgctgtgaagcttctttgttatgcttttgcgccacttcgtgcttactcaattgctgctttctggagaagctgtaacacagacacacctgctgtatttaattttgcctttcgtatcactttgtgcttacctcagctgttagtgatacctataacattttctttttaatctgattatcaaaggatgaattatgaatatcaacagttccatcttaccgcgacattt

SEQ ID NO: 71 - DNA, 2682 bp, Zea Mays
atgaagctgagtgctgctgttctcttcttctccatcttgttgcagtactgcaccagcagcggccagccagatagccgaggtttcataagcatcgactgcggcatcccggagaactccacgtaccaggacctcacctccaccatactctacgtctccgaccgcggcttcgtcacctccggcgagaaccgcaacatctccgccggctacatcagcccgtccctcgcgcagcgctactacaccgtccgcgccttcgcgtccggcgttcggaactgctacaccctcccctccctggtcgccgggaacaagtacctcgtccgcgccgccttctactacgcggactacgacggcctgagcacgccgcccgtcttcgacctgtacctgggcgcgagcctctggcacgaggtcaggttcagggacgcggccgcgatcaactggatggacgtcgtggccgtggctcccaccgacttcctgcaggtctgcctggtgaacaagggcaccggcaccccgttcatctccggcctggacctcaggccgctgcggagcactctttacccggaggcgaacgctagccagtcccttgtcatggtcaacgccaaccggtgcaacgtgggacccacggacaagtctgtggttcgcccaaccaaagcacatttctctggcccaacaagcaggtacccgctggacccccacgaccggatctggctggcgtacggcgccgtcccggcctggaccgaggcgtccgccacgtccgtcgtccggaactacctcgccgacccctacgacgcgccgtccgccgtcatgcagagcgccgcgacgccatccgacggctcggtgctcagtttctcgtgggacacgtccgacgaccgctccgtggacgccagcagcgccacgtacctcctcgtcctctacttcgccgagctgcagcgcgtgtcggcgagcggcgagctgcggcggcagttcgacatcgccgtcgacggcaccgcgtggaacagggaaccttactctccgccgtacctcttcgccgactccttctccggcacggtgcaggggcaggcgaggcatagcgtctcgcttactgcgacgaggaacgcgacgctcccgcctcttctcaacgccatggaggtgtacttggtgaggccggtggatgaagctgcaaccgaccctggagatgctaaagccatgatcgcaatccaagaagcttatgttgtgagcaaaaactggatgggtgatccatgtgctccaaaggcttttgcatgggaaggactggactgtactactgatcctccaactggtactccaagaataacagcattccttttatttcctgaactcggacatgaaattaagctgacaaatagtaccactgaaacattcgagctatttcttacaagaactgttacatataccagggacttgtcacacaataacttgtctggctccattccagattgtcttggacagcttccattcctagtgttcctggatctctccagcaatgacctccgtggaccagttccttacactcttcttcaaaaatcccacaatgggactctatcgctaaggcttagtaacaacccaaatttgtctgggaacggatcgggtccaaagaagttgaatggggccgcacttctctccgcgataatcatcccaacagttgccgccactgccttgtctgttaccttcattgctctgctgctccgagcactcaaggaacaagctagaagacgggctgttgatccaactccgagagatgagacggcgttgcttgagaaccgagaattctcttacagagaactgaagcacatcacgaagaactttagcctggagattggcagaggtgggtttggagctgtcttccttgggtacctggggaacggaaacccggtagctgtgaaaatccggtcggagtcgtcttcgcaagggggtaaagagtttctggctgaggctcaacatctgacgagggtacaccacaagaacctggtatccttgattggctactgtaaggacaaagaccatttcgcccttgtctacgagtacatgcctgaagggaacctgcaggatcatctgagactgagaggtctggagtacctgcatgtggcatgcaaaccagcgctgatccacagagacgtgaagagcaggaacatcctcctgaccacgggccttggggctaagatcgccgactttggtctgaccaaggctttcagcgactcggagacacacatcaccactgaaccagctggaacaatgggctacttggatccagagtacgtctcaggccagtccccggtcgtcccggtggacgacagcgtgagcgtccacgtcggcgagtgggtgcagcagagcctcgaccggggcggcggcgtcgagagcgtcgtggatccgagcatgggacggtgcgagcgcggcgactacgacgtcaactccgtctggaaagtcgccgacctcgcgctgcgctgccggcgggaggcctccagggagcggcctacgatgacggacgtggtcgcgcagatcagggagagcgtggagctcgaggcggcccgccggagctcggcgtcgggtgctgctgctgctggtggtggtgggggtctgaggagttgtgccggcgagagggacgcgtttgaggtggtggaaggaagcgttggggagacggcgggggccgcgcctggtccggcgatgatctga

SEQ ID NO: 72 - DNA, 1811 bp, Zea Mays
atgagcgacgtgtccgtccgcttcgtggccctggccctggccgccatctcgctcgccgccgccgccgccgccgcgcacgactacggcgatgcgctgcgcaagagcctgctctacttcgaggcgcagcggtcggggcggctgccgtacaaccagcgggtgcggtggcggggccactcggggctgacggacgggctggagcaaggggtggacctggtgggcgggtactacgacgccggagaccacgtgaagttcggcctgcccatggcgttcacggtgacgctgctgtcctggggcgtcctggagtacggcggcggcgtggccggcgcgggggagctggcgcacgcgctgcaggccatcaagtggggcaccgactacttcgtgaaggcgcacacggcgcccgccgagctgtgggcgcaggtcggggacggcgactcggaccactactgctggcagcggcccgaggacatgaccacgtcgcgccgcgcgtacaaggtggacgcggagcacccgggctccgaggtcgccgccgagaccgccgccgccatggccgccgcgtccgccgtgttccgccgcgccggggacgcgcactacgcgcacctgctgctccaccacgcgcagcagctgttcgaattcgccgacacccaccgcggccgctacgacgaaagcgtcgacgtggtcaagagctactacccgtcctccagcggctaccaggacgagctgctgtgggcggcgctctggctgcaccgggccaccggccgccgcgactacctccgctacgccctcgacaacgccgaggcgttcggcggcaccggctgggccgtctccgagttcagctgggacatcaagtacgccggcctccaggtcctcgcatcccagctgctggtggaggccaaggaggagcggctgcggctgagcgcggaggaggtggcggtggtggagcagctgcggtccaacgcggagtactacgtgtgctcgtgcatgaaccggaaccccggcggcgcgaagcacaacgccggacgcaccccggcggggctgctcttcatccggccatggaacaacctgcagtacgtctccggcgccgccttcctcctcaccgtctactcggacgtcctcgcctcgctgggccagcccctacgctgcggctccggcgacgacggtggcgaacccgccgccggcgacgcgggcgacgtgctggctttcgccaagtcccaggccgactacatcctgggcacgaacccgatgcgcaccagctacctggtcggatacggcgcggcgtacccgcggcgggtgcaccaccgcgcggcgtcgagcgcgtcgtaccggcacgaccgggacttcatcggctgcctgcaggggttcgactcgtggtacagcgcgcggcaggagaacccgcacgacctcgtcggcgccgtcgtcggcgggcccaacggcgaggacgtcttcaacgaccaccgcggcgcgtacatgcagactgaggcctgcacgtacaacacggcgcccatggtcggggtcttctccaggctcatgcagctggaggggcagtcgccacgcccggcgccggcgccggcggaggatctttgataggagaggtcgttttccttgaaaggttcccagcgacaagtggtggtgcgaaataaacttttcaaaaaggattaaaaaaagtgatattgatcgtttaggctggatgtatacatgattctttttgttgattcctagatactaccatatttgtttcatgtctttgcacataacaaaagaatcgaaaagaaggatgtaaatttcaaaaatgaactcgatctgttatttggctc

SEQ ID NO: 73 - DNA, 2892 bp, Zea Mays
tctccccccacccaccccgacccttcctcctcccctcggcctctccggcgggcgggcaattcggccatggatcccccacgcggaggaacagtgattgatcctactaaatgtcgattgatgagtgtggatgaaaagcgagaacttgttcgtgatttatcaaagagcccagaaagcgctcctgacaggctccagtcatggacacggcgggaaattgtagagattctttgttctgatcttggaagggagaggaaatatactggtttatccaagcagagaatgctagattatctcttcagggtggtgtctcgaaaatcatctggtccagtggaacatgtacatgagaaagagaaagggaaagataaagagtcaattcttgagcccaatacaactaaccatcagtcccctgccaaacgaccgagaaagagtgacaatccatcacgattaccgattatcacaaacaactcagcagcatctgatgtaactgggccaactaataatctacgcttctgccaaaatttagcttgcagggctattctcagggacaatttttgcagacgctgttcatgctgcatttgttttagttacgatgataacaaggacccaagcctctggttgtcgtgtagttcagaccaacacttacaaaaggatacctgtggtttctcatgccatcttgaatgtgctctaaaggatgaaagaacgggtattctgcagagtggacaaggcaagaaacttgatggtggctattattgcattcgctgttggaaacagaatgatttgcttgggtgctggaagaaacagctggtgatagcaaaagatgctcgacgattggatgtattgtgtcatcggatttatctcagtcataggatccttgtctccacagagaagtacttggtattgcatgatattgttgatacggcattgaagaaactggaggctgaggtcggtcctttatctggagctccaaatatgggtcgtggaattgtcagtcgacttactgttggtgccgaagttcagaaactttgtgctcaagcagtagatgctgtggaatcattgttctcgggtgtatctcctgctagttcaaaaattcagcggccatgcatgatgcgaccaaactttgtaaagtttgaagctataacccaaacatccgtcatggtatttttggatttggttgattgtcctatgcttgcccaagaggcaacttcttttaatatctggcaccgagtggctgttactgaatcgtacccatcaaatccgactggcataatacttgcgccattgaaaaaattacttgtcacttggctcgcaccggctacaagctatatctttaaggttgtcgcgttcaagaactcaattgagttgggttcatgggaaattagaatgaagacaagctggcaaaaggatgatccaaggggttcaatgccaggtggtaccggactaggacaaaatagtgagagcccaaaggcaaacagtgatggccagtctgatccttcctcagagggtgtggactcaaacaataatactgcagtttatgctgatctaaacaagtctcctgaaagtgattttgagtactgtgaaaatcctgagatccttgattcaaataaagcttctcatcaccccagtgaacgtattaatgacttgcaaaatatacagatggctgcagatggggtaacagaagtcacagagctggaagaagcacctgggctctcagcctcagccttggatgaggaacccaatgcttgtgttcaaacagtgcttctcagggattcaaacccactagaacacaatcagagaactgtggttcctagatcacatgatacatctaatatactggctggacatgagttggtgattgttggacctcgatattctggttctgtgcctcccactgcaccaagaagtgtggaaaacagcaaagacaatggtggaagggcctccaaacccaaaccttgtgacatagttgttcaaaatggctcttcaaagcctgaaagggaaccaggcaattcgtcaaacaaaagagcaacggataaaatggacgactttggccacaaggatagtttctctgaagtgtcctatgaatactgtgtaagggtggtcaggtggctggagtgtgagggctatattgagacaaacttcaggatgaagtttcttacatggtttagcttacgtgccaccctgcaagagagaaagatagttagcgtatatgtggatactcttatcgaggaccctgtcagtctctctggccagctcgtcgacagcttctcggagaggatatatagcaaaaagcggccttccatgccttctggtttctgcatggatctgtggcattaaggaactgcagggtcttaccgttcgctttgtagggagcatattcggcccattcttttgttgcagatcgttgcattgattcttcattggaaatttagctgaagtatttgacttgcacatcttcattgaaactttccttggtgatgacagtaggttatgttatcgtcgggcaacttctttttcccttctgttttttttttcttcatttgctccataataggttacagtgctcccatgttaatcttagagcatcaatgtgctgcattgttcagtcagcttagtgccgtcatgaattttgtggcgtgtagcttgtctgaagaagaggatggttgccaggctggatcaggaatgcgcctgtgggacgaagcaggcttcgtgtggacgctgacgaatccaagctaaccatgtcttgtcggtaaaatggttgtgctgtatcttcggggggatttgcattttcttgctgactctttctgggaatgggaggaatgatgtttaaggtgcagaacgtctgccttaatttaatgttatgttgactcatgctcctttatctgctgcatttgttggttc

SEQ ID NO: 74 - DNA, 2410 bp, Zea Mays
tctccccccacccaccccgacccttcctcctcccctcggcctctccggcgggcgggcaattcggccatggatcccccacgcggaggaacagtgattgatcctactaaatgtcgattgatgagtgtggatgaaaagcgagaacttgttcgtgatttatcaaagagcccagaaagcgctcctgacaggctccagtcatggacacggcgggaaattgtagagattctttgttctgatcttggaagggagaggaaatatactggtttatccaagcagagaatgctagattatctcttcagggtggtgtctcgaaaatcatctggtccagtggaacatgtacatgagaaagagaaagggaaagataaagagtcaattcttgagcccaatacaactaaccatcagtcccctgccaaacgaccgagaaagagtgacaatccatcacgattaccgattatcacaaacaactcagcagcatctgatgtaactgggccaactaataatctacgcttctgccaaaatttagcttgcagggctattctcagggacaatttttgcagacgctgttcatgctgcatttgttttagttacgatgataacaaggacccaagcctctggttgtcgtgtagttcagaccaacacttacaaaaggatacctgtggtttctcatgccatcttgaatgtgctctaaaggatgaaagaacgggtattctgcagagtggacaaggcaagaaacttgatggtggctattattgcattcgctgttggaaacagaatgatttgcttgggtgctggaagaaacagctggtgatagcaaaagatgctcgacgattggatgtattgtgtcatcggatttatctcagtcataggatccttgtctccacagagaagtacttggtattgcatgatattgttgatacggcattgaagaaactggaggctgaggtcggtcctttatctggagctccaaatatgggtcgtggaattgtcagtcgacttactgttggtgccgaagttcagaaactttgtgctcaagcagtagatgctgtggaatcattgttctcgggtgtatctcctgctagttcaaaaattcagcgtacgtgggccatgcatgatgcgaccaaactttgtaaagtttgaagctataacccaaacatccgtcatggtatttttggatttggttgattgtcctatgcttgcccaagaggcaacttcttttaatatctggcaccgagtggctgttactgaatcgtacccatcaaatccgactggcataatacttgcgccattgaaaaaattacttgtcacttggctcgcaccggctacaagctatatctttaaggttgtcgcgttcaagaactcaattgagttgggttcatgggaaattagaatgaagacaagctggcaaaaggatgatccaaggggttcaatgccaggtggtaccggactaggacaaaatagtgagagcccaaaggcaaacagtgatggccagtctgatccttcctcagagggtgtggactcaaacaataatactgcagtttatgctgatctaaacaagtctcctgaaagtgattttgagtactgtgaaaatcctgagatccttgattcaaataaagcttctcatcaccccagtgaacgtattaatgacttgcaaaatatacagatggctgcagatggggtaacagaagtcacagagctggaagaagcacctgggctctcagcctcagccttggatgaggaacccaatgcttgtgttcaaacagtgcttctcagggattcaaacccactagaacacaatcagagaactgtggttcctagatcacatgatacatctaatatactggctggacatgagttggtgattgttggacctcgatattctggttctgtgcctcccactgcaccaagaagtgtggaaaacagcaaagacaatggtggaagggcctccaaacccaaaccttgtgacatagttgttcaaaatggctcttcaaagcctgaaagggaaccaggcaattcgtcaaacaaaagagcaacggataaaatggacgactttggccacaaggatagtttctctgaagtgtcctatgaatactgtgtaagggtggtcaggtggctggagtgtgagggctatattgagacaaacttcaggatgaagtttcttacatggtttagcttacgtgccaccctgcaagagagaaagatagttagcgtatatgtggatactcttatcgaggaccctgtcagtctctctggccagctcgtcgacagcttctcggagaggatatatagcaaaaagcggccttccatgccttctggttctgcatggatctgtggcattaaggaactgcagggtcttaccgttcgctttgtagggagcatattcggcccattcttttgttgcagatcgttgcattga

SEQ ID NO: 75 - DNA, 1933 bp, Zea Mays
gtcaagagcagccgtcagccccgtcaccagcaagactcgccccccactactcttcctcctccaacctcccctcctgtctctccctccctccctggcagcgactactccccaacccgcacgcacgccgtgagcataaagccgtcgcgcgcccacacgcccgttttcatttccatcggttccctttccaaactcaacggccgcggcagggagcaggcacagtcacctccctgacccgttgagccgtcaattttatcccgccccgcgatttcctacagctgccgatcgaggaggaggcgcattgcccgcattcttctccgcttccaccgagagggcctcgcctgatcggcgccgccttggcccccatgacgtgtgtgcgcgccgaggacgccgtctcgcccgccgccgccgacgacgtggcggctgccctggtttccaggggcggcttgatccagaaggtggctgccggcggcgggcggagaccggcaggctcggcgcgctcgctgcagcgctcagcacatctggccaccggggacggcaacgctccggcgccggcggtggaggccagttgctcctggtccggggatgggataggtaagagcaacggtggtgggaagagagatgatagacacaggatgcggcagtacaggtcgcagctcgaacaggaggtcaagaaattgcagaggcagcttgaagaagaggttgatctgcacgtggcgttggcggatgctgttacacaaaatgttgcgcctatactgaagtcttctatgaagcttccacacaaggcacaggagctactgattaacatcgcctccttggagattaccgtttcaaaccttgaaaagaagctaaatgatctgtactaccagctttgtcacgaaaggaacgaaaggttacttgctgaaaataatcagggatgcttgccatctacatcctccgatgagcaccagtcattgtcaacttgcacgtgtacgtgggaagagcacatatcatcgttgagagatttgaagtttgggggatctgaatcaatgagatcaatgagacaggacttattccccgagcttgaagatgaccaggatatgggagaagatcctgagggtcaacagatagtttctttaaacaggctgctagaaaagcaccgagattcttctttgaatagacttcttgaaaagcatcgagatgaagagatgcaagaatctggctccatggaaaatgaaggcaatgaaaatgagcagcctgacacgttatcctttgaacagtctattctaaagataactagcataaaaggagggaatctttggagcaacccaaatgagctctctgaggagatggttcgctgcatgagaaacattttcctacgcttgtctgaatccttgaagatatcgccgaagacatcttctgattgttcatcttcctccgtggagcgtctatcaggctccacgttagcatctttctcagattcatccataatgccctcaatgctacggagtccttcagttgattctaatcacaatgacgagacgatgaaggaagtcaggaactttgatccgtataaagttaatggaaaggaaacccgaagagatatcggaaactatcgttcagcagctgaagtatcttggatgtctgttggaaaggatcaactagaatatgcatctgaagctttaaagaagttcaggtttgctgctacagccttggctaaacctatgagtcctcatagatatatcacatgtctacaaactgtacaaaccttagtgcatatatacaaaaattttagcatatgatgtatacttttaaattttgttcagccttgttaatgttctaaaagaatatgcagacaatcgaaccagtctagggatttggattgggggaacaaatggatgctctattcttgttcgcttgcagtaaagcaatcagtttcaaaattggtttgcgtata

SEQ ID NO: 76 - DNA, 2842 bp, Zea Mays
gtcaagagcagccgtcagccccgtcaccagcaagactcgccccccactactcttcctcctccaacctcccctcctgtctctccctccctccctggcagcgactactccccaacccgcacgcacgccgtgagcataaagccgtcgcgcgcccacacgcccgttttcatttccatcggttccctttccaaactcaacggccgcggcagggagcaggcacagtcacctccctgacccgttgagccgtcaattttatcccgccccgcgatttcctacagctgccgatcgaggaggaggcgcattgcccgcattcttctccgcttccaccgagagggcctcgcctgatcggcgccgccttggcccccatgacgtgtgtgcgcgccgaggacgccgtctcgcccgccgccgccgacgacgtggcggctgccctggtttccaggggcggcttgatccagaaggtggctgccggcggcgggcggagaccggcaggctcggcgcgctcgctgcagcgctcagcacatctggccaccggggacggcaacgctccggcgccggcggtggaggccagttgctcctggtccggggatgggataggtaagagcaacggtggtgggaagagagatgatagacacaggatgcggcagtacaggtcgcagctcgaacaggaggtcaagaaattgcagaggcagcttgaagaagaggttgatctgcacgtggcgttggcggatgctgttacacaaaatgttgcgcctatactgaagtcttctatgaagcttccacacaaggcacaggagctactgattaacatcgcctccttggagattaccgtttcaaaccttgaaaagaagctaaatgatctgtactaccagctttgtcacgaaaggaacgaaaggttacttgctgaaaataatcagggatgcttgccatctacatcctccgatgagcaccagtcattgtcaacttgcacgtgtacgtgggaagagcacatatcatcgttgagagatttgaagtttgggggatctgaatcaatgagatcaatgagacaggacttattccccgagcttgaagatgaccaggatatgggagaagatcctgagggtcaacagatagtttctttaaacaggctgctagaaaagcaccgagattcttctttgaatagacttcttgaaaagcatcgagatgaagagatgcaagaatctggctccatggaaaatgaaggcaatgaaaatgagcagcctgacacgttatcctttgaacagtctattctaaagataactagcataaaaggagggaatctttggagcaacccaaatgagctctctgaggagatggttcgctgcatgagaaacattttcctacgcttgtctgaatccttgaagatatcgccgaagacatcttctgattgttcatcttcctccgtggagcgtctatcaggctccacgttagcatctttctcagattcatccataatgccctcaatgctacggagtccttcagttgattctaatcacaatgacgagacgatgaaggaagtcaggaactttgatccgtataaagttaatggaaaggaaacccgaagagatatcggaaactatcgttcagcagctgaagtatcttggatgtctgttggaaaggatcaactagaatatgcatctgaagctttaaagaagttcagatttctagtggaacaattgtcaaaggttaatcctagctgtatggatcgcgatcagcggctagccttttggattaacttatacaatgctttgataatgcatgcgtatttggcatacggagtacctcgaaatgacatcaagcttttttctctgatgcaaaaggcttgttacacagttggcggccagtccttcagcgcagcagaaatagagtttgtgattctaaagatgaagactccagttcatcggccccaactttctttgatgttgactctgaataagttcaagattactgaggatcacaagaagtactcaatcgatgaattcgaaccccttcttttgttcggacttagctgtggaatgttctcttctcctgctgtacgcatattctccgctgcaaatgttaggcaggagctccaggaatctctgagagactatattcaggcgactgtcggtacaaatggcaaagggaagctgctgatcccgaagctagtgcagagctacgccaagggagctgtcgaggactctctgctcgcagactggatctgccaccaccttgcacctgatcaagccacggtcatccgggactcttcctcgcagtggaagcagcggctactcggagctcgaagcttcaccgttctcgccttcgactccaagttccggtacctcttcttgccagacagctgtggctcccagagccagaagccagaggcaaagcaatcttacaaacttcctgagccgtgttcagaatcagaatagataataagagctcagtttggtatatttggaccatcatacattcttttgcatagcgggccatgtgattggcagttgtatatgatgtaaattttgaggaagcttgaattgctgtgtttgcaaaaccggatcctctccacggagttggtggcaatttgggggtcgtattggttttcttttgtattcacttgtcttccatactgaagataacattcttttgttgtttttgttttatctgcataccttttcctttttttcccctctccttttctgtaaacctgtatggtcaatttgatctgtaacttctgcacaaataaaggtggtgagcagtctttacttaggtttttctgcacaactgattagggacgaagccagtcggtggggcgagcggggctcgacccccctacctcctatactaa

SEQ ID NO: 77 - DNA, 2301 bp, Zea Mays
aacctccctggtccctacttcccattgagtaccacagtctgatgggataggtaagagcaacggtggtgggaagagagatgatagacacaggatgcggcagtacaggtcgcagctcgaacaggaggtcaagaaattgcagaggcagcttgaagaagaggttgatctgcacgtggcgttggcggatgctgttacacaaaatgttgcgcctatactgaagtcttctatgaagcttccacacaaggcacaggagctactgattaacatcgcctccttggagattaccgtttcaaaccttgaaaagaagctaaatgatctgtactaccagctttgtcacgaaaggaacgaaaggttacttgctgaaaataatcagggatgcttgccatctacatcctccgatgagcaccagtcattgtcaacttgcacgtgtacgtgggaagagcacatatcatcgttgagagatttgaagtttgggggatctgaatcaatgagatcaatgagacaggacttattccccgagcttgaagatgaccaggatatgggagaagatcctgagggtcaacagatagtttctttaaacaggctgctagaaaagcaccgagattcttctttgaatagacttcttgaaaagcatcgagatgaagagatgcaagaatctggctccatggaaaatgaaggcaatgaaaatgagcagcctgacacgttatcctttgaacagtctattctaaagataactagcataaaaggagggaatctttggagcaacccaaatgagctctctgaggagatggttcgctgcatgagaaacattttcctacgcttgtctgaatccttgaagatatcgccgaagacatcttctgattgttcatcttcctccgtggagcgtctatcaggctccacgttagcatctttctcagattcatccataatgccctcaatgctacggagtccttcagttgattctaatcacaatgacgagacgatgaaggaagtcaggaactttgatccgtataaagttaatggaaaggaaacccgaagagatatcggaaactatcgttcagcagctgaagtatcttggatgtctgttggaaaggatcaactagaatatgcatctgaagctttaaagaagttcagatttctagtggaacaattgtcaaaggttaatcctagctgtatggatcgcgatcagcggctagccttttggattaacttatacaatgctttgataatgcatgcgtatttggcatacggagtacctcgaaatgacatcaagcttttttctctgatgcaaaaggcttgttacacagttggcggccagtccttcagcgcagcagaaatagagtttgtgattctaaagatgaagactccagttcatcggccccaactttctttgatgttgactctgaataagttcaagattactgaggatcacaagaagtactcaatcgatgaattcgaaccccttcttttgttcggacttagctgtggaatgttctcttctcctgctgtacgcatattctccgctgcaaatgttaggcaggagctccaggaatctctgagagactatattcaggcgactgtcggtacaaatggcaaagggaagctgctgatcccgaagctagtgcagagctacgccaagggagctgtcgaggactctctgctcgcagactggatctgccaccaccttgcacctgatcaagccacggtcatccgggactcttcctcgcagtggaagcagcggctactcggagctcgaagcttcaccgttctcgccttcgactccaagttccggtacctcttcttgccagacagctgtggctcccagagccagaagccagaggcaaagcaatcttacaaacttcctgagccgtgttcagaatcagaatagataataagagctcagtttggtatatttggaccatcatacattcttttgcatagcgggccatgtgattggcagttgtatatgatgtaaattttgaggaagcttgaattgctgtgtttgcaaaaccggatcctctccacggagttggtggcaatttgggggtcgtattggttttcttttgtattcacttgtcttccatactgaagataacattcttttgttgtttttgttttatctgcataccttttcctttttttcccctctccttttctgtaaacctgtatggtcaatttgatctgtaacttctgcacaaataaaggtggtgagcagtctttacttaggtttttctgcacaactgattagggacgaagccagtcggtggggcgagcggggctcgacccccctacctcctatactaa

SEQ ID NO: 78 - DNA, 1773 bp, Zea Mays
atggaggtggcgcgcaccttccatccccgcggcgcgcaccgcttcctgtgggcttcctgtgggcagcagatccatagacctcaagcctgcaaattggtggtttcttggttcttatcagtggagctggctttggaatttgcatgcaccgttctgagctgcgttgctgctcctggaaaggtgctggtgccttcattcgggcaaaggcaaagcgcaaggcaaataaacttagttgtttctcatccaaataccagtggagacaaagatgtgacttcagataacaaatctcagcatggatcttcagaattacctcctagagctgaattgattggaccaacttcttttgcacctcttatttatgcagcgatttatgttgttgaaaacagtaattggcagtaccatgtcctcgtgatcatagctgatgggcaggtgtttgtacaacacagtgaaaggtcattccatacctcagatgtaacaagcaagaataaccagtgggagatgtactcagaaacggtcccaaagtatcgtgatactaaagtcaggacaaaggaacccctggagcaatataaccaaaccaaggacgatactgactacttatggtacaccacaagctttcgcttggagtcggatgatttgccctttagaaatgacatccggcctgtgcttcaggtcaaaagtagtgcacacgcaatgatgggatttgctaatgatgctttcgtaggatgtgcacgcagaaacaagcaggtgaagggtttcatgtttgaaaaaccggttgatctgaaagtaggtgtgaaccatgtcgtattgctgtcatcaactatgggaatgaaggatagtggtggtgaacttgctgaagtaaagggcggcattcaggagtgcctaatccaaggtctcaacactgggacgttggatttacaagtcaatggctggggccataaagctgcactagaaggtgagtacaaggagatctactcagaaaaggtttgggcaaagttcagtggaaaccggccgagaacgaccgggcagccacttggtataaggtctcataccgaactcttgctggaactccttctcaaggagtgtaagtctgtggagttaaccttattgaggcaggtcgtatactgttcttggccaacaagcttgacaacaaaaggtcttttcatttgccatcgtggcatctgtggagcgggtgtggagcgggtgttcgcggacaaggcggtgccgtcgtggcgggagcagctcacgctgcgggcattcgtcatcaacgcgctgctggccgtcatgttcagcgtcatagtcatgaagctcaaccttaccacggggatcatcccctccctcaatgtctctgttgggctgctcggcttcttcttcgtctgcatgtggactgccgccgccgagaggatgggcttcctccgccagcccttcaccaggcaggagaacactgtcatccagacctgcgttgtctctgcctacgacatctccttcagcggtggctttggcagttatctatttggaatgagtgaaaaaatagctaaacaagcaacaacggtggcacacatctttgagttgcctgaagaaaagctatgcctctctttcctttccaataataacacgggcgaagacgaaacagtgatcttccgaggggataagcactatgtggctagccgttctgtctccattatttggggttaccgaggagagtgtgatcgatattatccatgcttgataaatgatgacaatggtgatggccatgatatatggtcaatattgtattga

SEQ ID NO: 79 - DNA, 3597 bp, Zea Mays
atgatgttatcagaccccaaagattgcacgctctgcaagggtagagaaataattattggggagcatgttacaaacatgatgcaaattttctccttaaagttggctaagattgatgtggatggtggccccatagagttgtatggatatatcgctacgcgggatgttctcgagccattgcttaactatattgtcaatgttagcaggaatgatcctatcaccatcgagcagggttccctcatagaaatgactggccctaagcgaggcattgagttgtgtggcgaaattatgcttgaatttgacatgaggattaagaggggcggagaagagaaagacgacccacagctgattgatggtgtagcaatcgtactagacgagatgagcatgcctaggagtacttatgcattcacaaaacggatccacggcgattgtggagcggttgacataacggtatcacgccttgactttgcagttgaggcgacgatacaacttcacggcattcttatagcagtgatgacaatccggaacattggtgtagcttcaaaacgaccagtcatggatggacctgccaacagccgagaagctgctaaccagctgtggcaaatgcgccgggaaaagaaaagggtgtggatgtgtgcccacagcagccatgcagaagccatgcagcagcagcaacgggtgcatccctcacatgacaacgacaagcacaacaacgatgggtttctcaaacctctcctaggcctcgcgctcgcgctcttgctatccgccttcctcccgcctacgagctcgtgctcggagcaggagaggagcgccctcctccagttcctcgctggactctcgcgggacggcggtctcgcctcgtcgtggcggaatggcacgggctgctgcgcgtgggaaggggtcggttgcggcgcagacggggcagtcaccgatgtctcccttgcttcaaggggccttgaggggcaaatctcggcgtccctgggtgagctcaccgcgctgctgcgcctcaacctgtcccacaacctgctgtccggtggcctgccggcggagctgacgtcgtcaaacagcatccttgtcctcgatgtcagcttcaaccgtctcaacggaggcctgcgcgagctaccttcgtcaacccctccccgtcctctgcaagtactcaacatctcgactaacttgtttacaggaccgtttccatcgaccacatgggaggcgatgaccagtctggttgcactcaatgccagcaacaacagctttaccggacagataccaagccatatctgcagtagctcaccggccttggctgtgattgaagtctgctataaccaactcagtggcctcgttcctcctgggcttggtaactgctccatgctcagagtgctcaaggctggccacaatgccctcagtgggtcactccccgatgaactcttcaatgctacgtcactagagtacctctcttttcccggcaatggtttgcacggaatgcttgatagcgaacacatcatgaagctcagaaatctggcccaccttgatcttggaggcaacaggctaagcggaaacatcccagattccataggccagctcgagaggttagaggaactgcatctgaacaacaacgacatgtctggggagctgccatcaactctaagcaactgcacaaatctcataacgattgacctcaaggtcaacaacttcggcggagagcttcagaaggtcgacttcttcagcctgcccaatctgaaaacattggatcttctgtacaacagcttctccggcacggttcctgaaagcatctactcgtgcagcaagctgaatgcgttgcggctctctaacaacaacttgcatggacagctttccccagcaatagccaatttgaagcatcttgttttcctgtcactagtttccaacagttttacaaatatcacaaatacgcttcagatactcaagaactgtaggaatctcacctccctacttattggaagcaacttcaagggtgaggacatgccagaagatgagacaattgacgggtttcagaatcttcaggttctttccatgtctaactgctcgttgtctgggaaaatacctctttggttatcgaagctcaaaaatttgcaggtgctgcttttgcacacgaatcaactcagtgggacaatacctgcctggatcaaaagcttagagtcactattccatctagacatatcaagtaacaagcttacaggggaaataccaacagccttaatggagatgccaatgctaacgacagaaaagactgcaacccatttggatccaagggtatttgagctacctgtttataaaaacccatcgctccagtaccggataaccagtgctcttccaaaactgctgaaacttggttacaataacttaactggtgcgattccccaagaaattggtcagttgaagtcgctcgctgtactcaatttcagctcgaacaacttatcgggaaaaataccactggaactctgcaacttaacaaatctgcaagtactagacttgtctaacaatcatctcagaggtgcaatcccatcagcattgaacaacctacacttcctctccgcactgaatatttcttacaataacctggaagggcctattcctactggaggccaattcagtacattctcgaataatagctttgaagaacagtcattagtgatagtgccaagaggagaagggggagaaaacaagctcaaattcgctgacattgtgaaggccacaaataacttccaccagggaaacatcataggttgtgggggctatggtctggtctacaaggctatattacctgatgggaccaagctggccatcaagaagcttaatggtgaaatgttgaccatggaaagggaattcaaggcagaggttgaagcactctccatggcccagcatgagaatcttgtgccactgtggggttactacatacagggagattcaaggctcctcgtatattcctacatggagaatggcagccttgatgattggcttcacaccatggatgatgatgccagcacatttctcagttggccgatgcggctgaaaattgcgcaaggggcaagccaaggcctttcttatatccatgatgtctgcaagcctcacattgtccaccgtgacataaagtccagtaatatcctacttgacaaagatttcaaggcttacgttgccgattttgggctctcaagattagtccttgcaaacaaaactcatgtcacaactgagctagttggcactctgggctacatcccacctgagtatgggcaaggctgggttgcgacgttgagaggtgatatctacagttttggagtcgttctgcttgagctgctcacaggaaggcggcctgtctcagccttgtttttatcaaaagaacttgtgaagtgggtgcaggagatgaaatcagaagggaagcagattgaggtcctcgatccacatctacgaggcttggggcatgacgagcaaatgctgaaggttcttgaaatagcctgcaagtgtgtcgaccatgacgcgtgcatgaggccaaccatactggaagtagcctcctgccttgacactatagagcccaccctgaggatgcaaaattcagttaggatatag

SEQ ID NO: 80 - DNA, 1075 bp, Zea Mays
gaccattttggggcgcacatataagccaccgccgcctcgcatctcctcctccgccccacgcagctgaggcgttgatcctcaccggcgtcgccatcgtaatcgccttggacagcggcaccagaacctctgcctccgcagggtgcttgctggtatcattacaatctggtagttttagtggttgggcttgacttcctactattcagaaacacagtaccgagaagtctttaggtggggtcaaagatggtgtcgctgaagttgcaaaagcgccttgccgcgagctacctcaagtgtgggaaaggcaaggtgtggcttgacccaaatgaagttagtgagatctccatggcaaactcccgccagaatatccggaagttggttaaggatgggtttatcatcaagaagcctcataagatccactctagatcccgtgcaagaagggcacatgacgccaagcaaaagggacgccactcaggatatggtaagcgtaggggtaccagggaggctaggctacccaccaaggttctgtggatgaggaggatgcgtgtgctgaggcgccttctccgcaagtatcgtgaggccaagaagattgacaagcacatgtatcatgacatgtacatgaaggtcaaaggtaacgccttcaagaacaagagggtgcttatggagagtatccacaagtccaaggctgagaaggccagagagaagacactttctgaccagtttgaggccaagcgcgccaagagcaaggcgagccgtgagaggaagatcgctaggagggaggagaggttggcccagggtccacgagaaataacaccacctgtctcatccacagctccagctactggggcaccgaagaaagcaaagaagtgaagtattgaaataaagctgtagctttctagtccagtactgcactttcttttataagctctagtcaaattttggagcgcctgaactgttttgctgttatataacttagtgtattgataaattcgactatcacatctggattattctgctggataatgtccgtgtctttgatgtttgtgttaaattcctattctggatgagcacctggccctaa

SEQ ID NO: 81 - DNA, 1182 bp, Zea Mays
gaccattttggggcgcacatataagccaccgccgcctcgcatctcctcctccgccccacgcagctgaggcgttgatcctcaccggcgtcgccatcgtaatcgccttggacagcggcaccagaacctctgcctccgcagggtgcttgctggtatcattacaatctggtagttttagtggttgggcttgacttcctactattcagaaacacagtaccgagaagtctttaggtggggtcaaagatggtgtcgctgaagttgcaaaagcgccttgccgcgagctacctcaagtgtgggaaaggcaaggtgtggcttgacccaaatgaagttagtgagatctccatggcaaactcccgccagaatatccggaagttggttaaggatgggtttatcatcaagaagcctcataagatccactctagatcccgtgcaagaagggcacatgacgccaagcaaaagggacgccactcaggatatggtaagcgtaggggtaccagggaggctaggctacccaccaaggttctgtggatgaggaggatgcgtgtgctgaggcgccttctccgcaagtatcgtgaggccaagaagattgacaagcacatgtatcatgacatgtacatgaaggtcaaaggtaacgccttcaagaacaagagggtgcttatggagagtatccacaagtccaaggctgagaaggccagagagaagacactttctgaccagtttgaggccaagcgcgccaagagcaaggcgagccgtgagaggaagatcgctaggagggaggagaggttggcccaggtatgataatgttatgttgatccataccttgcaattcgtttagaatcttgtttaaatgtatgctttgtcgtatagggtccacgagaaataacaccacctgtctcatccacagctccagctactgggtaagcgccttggagctctttgtttcgtttccttggattttatcatgtttttttgttgatgtgtttctctttgtttggccgatgtcacagggcaccgaagaaagcaaagaagtgaagtattgaaataaagctgtagctttctagtccagtactgcactttcttttataagctctagtcaaattttggagcgcctgaactgttttgctgttatataacttagtgtattgataaattcgactatcacatctggattattctgctggataa

SEQ ID NO: 82 - DNA, 836 bp, Zea Mays
gaccattttggggcgcacatataagccaccgccgcctcgcatctcctcctccgccccacgcagctgaggcgttgatcctcaccggcgtcgccatcgtaatcgccttggacagcggcaccagaacctctgcctccgcagggtgcttgctggtatcattacaatctggtagttttagtggttgggcttgacttcctactattcagaaacacagtaccgagaagtctttaggtggggtcaaagatggtgtcgctgaagttgcaaaagcgccttgccgcgagctacctcaagtgtgggaaaggcaaggtgtggcttgacccaaatgaagttagtgagatctccatggcaaactcccgccagaatatccggaagttggttaaggatgggtttatcatcaagaagcctcataagatccactctagatcccgtgcaagaagggcacatgacgccaagcaaaagggacgccactcaggatatggtatgctgctgcaactcatttatgtcacagttctgaagggtgagtaagctcgtggtaatccgatgcctgtataggtaagcgtaggggtaccagggaggctaggctacccaccaaggttctgtggatgaggaggatgcgtgtgctgaggcgccttctccgcaagtatcgtgaggccaagaagattgacaagcacatgtatcatgacatgtacatgaaggtcaaaggtaacgccttcaagaacaagagggtgcttatggagagtatccacaagtccaaggctgagaaggccagagagaagacactttctgaccagtttgaggccaagcgcgccaagagcaaggcgagccgtgagaggaagatc

SEQ ID NO: 83 - DNA, 804 bp, Zea Mays
gaccattttggggcgcacatataagccaccgccgcctcgcatctcctcctccgccccacgcagctgaggcgttgatcctcaccggcgtcgccatcgtaatcgccttggacagcggcaccagaacctctgcctccgcagggtgcttgctggtatcattacaatctggtagttttagtggttgggcttgacttcctactattcagaaacacagtaccgagaagtctttaggtggggtcaaagatggtgtcgctgaagttgcaaaagcgccttgccgcgagctacctcaagtgtgggaaaggcaaggtgtggcttgacccaaatgaagttagtgagatctccatggcaaactcccgtaagtattatccactgcttggttctgcctggttcgtaatatgtttgacttctgctctgatttttgctattcttgtttgggtctgtgttcagctgtgatcttgacatcatatgagctgtggcgatctgtttgtagtgttcttggtccatttttctgctgttgagctttatagccgtcaaaatgggtagcacagttcactttatgggcatggtcaaaggtggatactttatgtagtttgaatatgttggatcaaacattattcttaccgccatggtttttaaagcggtaaggcggtccaaggcgttggaccaccgctacgcctaggcggcgcctaggcgttagaccaccgtccggacgcctaggcgacgccttaagaacagagcttaccgccaccatgttatagtgttatttacctgccaccacccttgaagacactattggctgtagctgct

SEQ ID NO: 84 - DNA, 725 bp, Zea Mays
acacgaaaccccagcacctcccatataatttgtctctcgtgcctcgttgcgtctttgtcgagtctaaccctagcgcgcgccgccacacctgccgttgctaccgccccgtacctcgcttgctttcccgtcgccgaaatgaatgcctatgcagacgaagcgcaccaagaaggctggaattgttggcaaatatggaaccaggtatggcgctagcttgcgtaagcaaatcaagaagatggaggtatctcagcactccaagtacttctgcgagttttgtgggaagtttgctgtgaagaggaaagcagttggaatttggggatgcaaggactgtgggaaggtcaaggctggcggtgcttacaccatgaacactgctagtgcagtcactgtcaggagcacgattcgtcgcttgagagagcagactgaagcatgatttagcttgctacatcagggttctcctagttgctgttgtcgggaatgttgagctcctctagttggatcacgagactggctaaaagttgggtgctaagatttgtagttggttaccgttgtgaatttctcaagtgatattatcctatgcttgtctcaatgactcaaatttggttgtggtttctatgcttttggctgtgtcaatggtttgccattgttgaaattcaacccttaatgctgcctcttataataaaaagtttttttattggtctggttcagaaagcaagattatatacgcttct

SEQ ID NO: 85 - DNA, 712 bp, Zea Mays
acacgaaaccccagcacctcccatataatttgtctctcgtgcctcgttgcgtctttgtcgagtctaaccctagcgcgcgccgccacacctgccgttgctaccgccccgtacctcgcttgctttcccgtcgccgaaatgacgaagcgcaccaagaaggctggaattgttggcaaatatggaaccaggtatggcgctagcttgcgtaagcaaatcaagaagatggaggtatctcagcactccaagtacttctgcgagttttgtgggaagtttgctgtgaagaggaaagcagttggaatttggggatgcaaggactgtgggaaggtcaaggctggcggtgcttacaccatgaacactgctagtgcagtcactgtcaggagcacgattcgtcgcttgagagagcagactgaagcatgatttagcttgctacatcagggttctcctagttgctgttgtcgggaatgttgagctcctctagttggatcacgagactggctaaaagttgggtgctaagatttgtagttggttaccgttgtgaatttctcaagtgatattatcctatgcttgtctcaatgactcaaatttggttgtggtttctatgcttttggctgtgtcaatggtttgccattgttgaaattcaacccttaatgctgcctcttataataaaaagtttttttattggtctggttcagaaagcaagattatatacgcttct

SEQ ID NO: 86 - DNA, 1709 bp, Zea Mays
ccgcttcacgccttcacctcttcctcccattcttcgtgtgaccttgtttgtcgtacagccgatgcccagttctgtctggccgcttgttcgcgcgagatctagagtgcttgacttcgcagtccagctcctgttcgatatgtattcggccaggctcaatagtttagttttcgggattaggatcatgtacaacaatcatactttggatcagtcgttgtgttcctgtgttttcatgtaaatctaagcccgttggtcgtaacactgttagtctggaatagctcgcgctttaaagtgcaatatattgctagcctgctgctagggtcatgcgggtatttggaatgtgctagccttgaatatgcaatttagggtggcacgctgccttttgtgcattatatgtttggagaagttgctatctcaggtttcctagggtgaggcacaaactgtgtaaagctaaagggtaaaggccacaagacatcatccaaaaactgctacagtaagggcaggaagctaactatatgtttctactccacatttaagccctaaagtgttcttggtgatcttgttaattgacaacatgttgaatgtaaattccacacagtattttatgagtcctttgaggtatgctgtatgtgtggttttcgtccttagtgtttgtgcaagttctagcaaattggaaaaattcattgttagtttagtgcacaaaggcaaactagcctgacacctttgccatgccatcagtagccactccactgcaccaggcagcatgcaacatgaaagtagtatccaatgcaaagcttagcctttgaacacctaatgtataaatcagtggcttataatacttttctcctttgttgattttagttattatgcctttgcttgtcaaatgtatatcgggtaaattctctcttgctgctagtggagagttaatagcaactaactgaccttaatgttttttagtggtctacatatctattgtttaagaaactatatttttctcttgttgattgttaaggtacctgagtgtgtgcaatcttttatattgatactaactttattcttgaaaagttgcagctttacacttaccagttatattgcattgaataattttagtgagcagttgtgatttattttgtttttataatgcctatgcagacgaagcgcaccaagaaggctggaattgttggcaaatatggaaccaggtatggcgctagcttgcgtaagcaaatcaagaagatggaggtatctcagcactccaagtacttctgcgagttttgtgggaagtttgctgtgaagaggaaagcagttggaatttggggatgcaaggactgtgggaaggtcaaggctggcggtgcttacaccatgaacactgctagtgcagtcactgtcaggagcacgattcgtcgcttgagagagcagactgaagcatgatttagcttgctacatcagggttctcctagttgctgttgtcgggaatgttgagctcctctagttggatcacgagactggctaaaagttgggtgctaagatttgtagttggttaccgttgtgaatttctcaagtgatattatcctatgcttgtctcaatgactcaaatttggttgtggtttctatgcttttggctgtgtcaatggtttgccattgttgaaattcaacccttaatgctgcctcttataataaaaagtttttttattggtctggttcagaaagcaaga

SEQ ID NO: 87 - DNA, 717 bp, Zea Mays
atggctaactgggcctacgacatgggtaagcaggccgacccatctatgggcgtgcgcagtccctttaagtgggtggcagttagggttttgcccatcagccgccgcccaggccagcgccggccgcttccgccatcgcgccgcgccgaggccttctgtgggcgcaccagtgaactgctgcggggccgcgccgcgcgctggcgcgctgctcaggccggtcgagcccaagccgcgagctgcagaggcgggttgccgccgcgccgcaagctgcaaaggcgggccaccaccgcgccgcgcgctgctcaggccgagcgagcccacgccgcgagctgcagaggcgggccgccgccgcgtcgcacgctgctcaggccgcagaggcgggcgagccaccacggaccctgtcgaggccacgtcgcgctggagatcgggcgcagccgcgccgtggcagtgaccgccgcacagggccgagcgcgccgtgtccgggccgcgcgctctgaaggccgggcgaggccacacatcagggaagacgacgaggcggggagcgcgagcgctcgcggacgtcgtcgtcggatggtcttgcggtcgcaaaccacgattccggcgcacgtggctgtggggaaaggtggtgcgcgagctgacggaccactctgttgtcgcttgggctcaagagcgccggcggtgaggccgttcccgatgggccgtcgtcgagagtcggagtag

SEQ ID NO: 88 - DNA, 1182 bp, Zea Mays
atggccaagacagcaaggcaacatgccaacagcccacatgtatgtacacgtgatgtttctattactcaaactgatcttgctgcaagtacatctaactcaatttgtataaatactgacattgacgagtttatatatgaagataatgatgcagccaaaggtgaaataaatgaattggatgtgtacatgaaagataaaccaattcggtgggttgatcctactgatcgcaatgataaggtaccgtcaattgttgaggagttcatggcagatgaaaatgaatatagctcgacaattgaagaggacaggaggaggccgcggcaggcagaggcagccggccgaccgaccgaccgaccctgggacgtggacgtggtgacgcggtcggggaaatcaagactcaacagaccgacgcggcgcccgggtcgtggcgggccccggtgcttcagcctccgcggggccgtgccgaccaaacaggagcagccgcgggcgggactgcgggaggaaaggaaaagaaaggccactcggggcggggcggggcggggccgggccaagccaaacgcggagtcgccgaggaggaggacaaggcagggcagagagggagggaggaagaggaggaggagcgggatgcggcgggcaaggccgccgccggtcccggtcccgatgacgccgggggacgctgggccggaggtgaagtaccgcggggtgaggcggcgcccgtcggggcggtacgcggccgagatccgggacccggccaggaagaccccgatctggctcggcaccttcgagtcggccgaggccgcggcccacgcctacgacgcggccgccaggaccatccgcggcgccgccgccaggaccaacttcccctccgcctccatctcagccacggtggcgccgccagccgcccccgccgcgacgtctagccacagcagcaccgtcgagtcctggagcggcggcagcggcggcggcgcgcccgtcgggatcctccgcgccccggccgccgaggaggactgccgcagctactgcggctcctcctcgtcggcgctctgcgaggacggcgcgtcgggcccgggctgtggcgacgagaccgccgcgccgccgcggtgctccccgcttccgttcgacctgaacgtgccggaccccgcggccgacgagatggactggcgctgcgacacgctgctgcacctgtag

SEQ ID NO: 89 - DNA, 1400 bp, Zea Mays
aagttggtagactattgtctgatccgcaccgttggctgcgtcacattctctacgcctcgtgctccttcccttctaccgttcggctgcgtacccgcgtctccccagatccgctgccccgccctctcgacgcggcaattcctcgaacgccccgcgcgagccacgccctcgccgcccatgggctcgctcccggcgccggcctcggcggaattcgccccgcggccgcgggggcgcgccacggtggtggcgtcggacctggcgccgctcttctccgcgcagcgccggcacctggaccacttcttcgaccgcctcgacatggcgcaggcggcggcgttcgcgcaggcgctgctcgacgcgccgggcgccgtcttcttcacgggcgtcggcaagtcgggcatcgtggcgcgcaagaccgcgcagacgctggcgtcgctgggcctcgcgcgggccggcttcctcgcccccgtcgacgcgctccacggcgacatcggcgcgctcttccccggggacgtcctcgtgatcctctccaagtccggggcctccgacgagctgctcgcgctcgcgccctgcgcgcgcgccaagggcgcctacctcgtctcgctcacctccgcggcctcgggggatgactgcccgctcgccgcggcctgcgacctcaacgtccacctgccgctgcagggggaggtgtgcccctttggcctcgcgcccgtcacctccaccgccatccagatggtgtttggggacaccgtcatcgccgccatcatggaggcaaggcgactctccagggaccagtacgcttccaaccatcccgctggcaagatcggcaagaccctcatcttcaaggttaaggatgttatgaagaaacagaatgagcttcctctgtgcaaggagggagatatgataatggaccaactcaccgagctcaccagtaaaggttgtggttgtctgcttgtggttgatgaagagcatcatttgattgggaccttcactgatggtgatctccggcggacactgaaggcaagcgggccagctatcttcagtctcacagttggagagatgtgcaacaggaacccaaggacaatcactgcggaggcaatggcagttgaagccatggagaagatggaggcaccaccttcacccgtgcagttcttgcctgttgtcaacgagaacaacgtcgtgtgtggaatcatcacattgcatggattggtctctgccggattgtagacttgtgtggcaccattacctgttagctagctgttaccgctggagtatttatgtggagcctgaactcttcagtgtacccttatgtacagtatagtggtcgctaagaggaacatggtacactgcttataatgcttgtgtttttgtacttaattttaaatgccgattgccttggtttctcttga

SEQ ID NO: 90 - DNA, 1183 bp, Zea Mays
ccttggcatgctgtcagtccctcccaacctccattccttcctcctttgccaatgcagctctgatctctcctacctgagaatgtcagtgtgagtggccattccatctgcacaacatcctcctccacgcacgcaaaacatacaaaaaggcagaagcggaggagatgaaggcaatggccgggccaaagctgctcgtcgtccacgcgtcgtcgaacaaggccctgaacgggatggcgcccacgtcgccggcgtcgcccggctggtcgcggtgcctgtggctggtggtgttcctggccttgttcacctgcgtgtccctcctgaccgtgctctccacggcgcgcgcctcggccggggcgccggcgtgccaggcggcgtcgctcacggccagcgctgccggcgccacggaggccggcctgccgcggcacgtgttcgacgcgctggtgcagtacgcggcggcggcagggaacttgtcgtcgagcatgccggagccggacgtgcgcgcgatcgcgtcggtgctccggcggcgcgcgccgtgcaacctgctggtgttcgggctgggcgcggagacgccgctgtggcgcgcgctcaaccacggcgggcgcacggtgttcctggacgagaacccgtactacgtggcccacctggagggtaagcacccggggctggaggcctacgacgtggcctacgccacggcggtgcgcgagctccccgacctcctcgacgccgcccgtgccgcgcgcgccgctgagtgccgccccgtccagaacctgctcttctccgagtgccgcctcgccatcaacgacctccccaaccagctctacgacgtcgcctgggacgtcatcctcgtcgacggcccgcgcgggttcatggaggggtcgccggggaggatgtcggcgatctactcggctgcggtgatggcgcggaccaagggcgcggagacggaggtgatggtgcacgactacgagcgggaggtggagcgcgcgtgcggccgggagttcctgtgtgacgagaaccgggtcacggcgaccagcacgccgtcgctcggccacttcctcgttcgcggcggcgccgccgccaaccgggaagccttctgcgggccgcccgccggcgccgcccagaaatcgaaaccgagctaagcgagtcgtagtcgttacttctcaacgaatcaagctgattcatcagaagt

SEQ ID NO: 91 - DNA, 1104 bp, Zea Mays
tgaaggaaaacgggcgagagactagacaaaccatagaagccgccactcacgcctggaagcatctggaggcgtggcacggcagccgtcgcccgccacaccagcagcgaactgcttcccggtgcccgcggcggcgaagcacaggagagaggcggcgagtgaaaccgatgacgccgccgatggatccgcccgacgtcgagatggagatggagcccgcgccccagcctccggctccgacagcggtcggggaggggtggagcatgctgtcgcgcgcccgcgggctgctcgaggagggcaaaccgtccctcgctctgcaggcggttctcttggccataagatctcaaggcggtgaacaagctctcatgcagacattgaaccgtgcacgtgaactctatgcacagagattgcaggccagtcctagtgttgatgagcttgcctctttgcttgcccaatgtgccatagcagaggctcagtcatcaaatactaaccctccacaagggcctgggtcagaccctgtcaatatgctgaattctgatgaggcctgcattcttgctgagagtggaaggaagcagatcatcctggacgcatttgctgatgggagcagcttcatttgcttgaaatgtggggggctctttagcacatctcgcaaggatgagcacttagcctactggtgcgggactgcatgatcctggttacgtcttgctgtggtatatccatggtcacacctagcaatgaaccgatgatcatgatacccgtgagattttgtataaactttgttctgttccaatccgattactgcttctttactgcggggatgccagaggcacgtctgttaagtcgtagtaaatacatttgccgatgacaaactttatgaacgaaagtttccatctctatccgcttgttgtacttgtgctttcggctgatggaatgtgttgagatgtttggcatggtcatcaaattctaatagttgaatgtgacgaagcaatgttcttgtggttagctctgatctgatcacgcaaatactgaagctgggtagaaagtttggaggaactgatgatatgccccttcgctttcggttttattgagttgaaaactggatttagcagt

SEQ ID NO: 92 - DNA, 759 bp, Zea Mays
gaagagaaaagaagggcggtgccctcttgagcccggtgagatcgctgtgatcctgcgggcactggggtacacgagcggcacacagatatacgtcgcgtccgggcaagtgtacggcggcaagaaccggatggctcccctcaggaacatgttccccaacctggtgacgaaggaggagctagcgagcgcggaggagctggcgccgttccggcggcacgtgacgagcctggcggcgctggacttcctggtgtgcctgcggtcggacgcgttcgtgatgacgcacggcggcaacttcgccaaactcatcatcggggcgcgccgctacgcggggcaccgcctcaagtcggtgaagcccgacaagggcctcatgtccaagtccctgggcgaccccgacatgggctgggcctccttcacggaggacgtcgtcgtcacgcaccgcacgaggacgggcctccccgagcccaccttccccggctacgatctctgggagaacccgctgacaccctgcatgtgcagggcatgagacgggccatccctcagatcagagtggccgtctggccgagtcctcgtcttcgctaggctacgactacgagtagtctcgtgctcacttccatcagcgcgcatttcagcgagcatatgcttctactagttaaacacctagatttgtatgtatttggctggcctaatctgtagtttcacatagatcacttcatgctgaaaatgtcttggacaaggcagtgaatgaagataacatcagtaacg

SEQ ID NO: 93 - DNA, 1566 bp, Zea Mays
gttcgctaaacctcgcgcacagaaacacaagcgagtaccagagcagctaggagtggtcagcaatggcgcagcttaaagcagccgccgacgagcagcaggaggcggcgctgcacggcgtcgcctccggcggcgggaacgagagcaacaagaaggcgcgcgcggggctctgcggcctgctccgcgagcgcaaggtggtggacctggcgcgggccaagcggcggctggtggaggttccctacaccgcgacgctggcgcacacggccaacgcgctcctggcagcgcgcgtctctgccgtggccgtggctgcgccaccgggccactggatcggcgccggcggctccatgatcctcgagtccgacccggccaccggcgccgtccgcaagcactacatcggcatggtgaacatgctcgacatccttgcccacatcgccgaggccagcgacgacgacgaggcggccgacctcgaccgccggatggccgtgccggtgtcctccgtcatcggacactccctcgagggcctcactctgtggacgctccacccgagcaccagcgtgctggactgcatggagacgttcagcaagggtgtgcaccgcgcgctggtgccgctggagagctcggcggacaacgtggtggcgctggagctggtggagtcggcgccggggtaccggatgctcacccagatggacgtggtgaggttcctcagggcgcacggcgcggagctcaggggcgtgctgttgcgcaccgtgcgcgagctcggcgccgtgaacgacaccgtgttcgccgtctctggcgttaccaaggtgatcgacgtcatcaaggcgatgcgggcggcgtcgctgaccgccgtgcccgtcgtggacgccgtcggtagcggtacagagacccttcaatacgggagcgggcaaagggcggtcgagacgttctcggcgacggacctgcgggactgcccggtggcgcggctgcaggcttggctggggatcagcgtgatggagttcaagaggaaggtggctgagtaccgcgccagcaccaggcttgtggtccccggcgccgacgccacggacactggcacccctgtcgccgggtacgccgacacccccgcggctgccgccgccactgacgaagagcagagcgagcagcaggagtcggcgctggtgacgtgctcccaggagagcaccctcggcgaggcgatcgaggcggcgacatcgaggcacgtgcaccggctgtgggtggtcgacgaggaagggctcttgcgtggggtcgtgtcgctcaccgacatcctccgggcagtgcgggaggccgcgctcggcgaggacctggagctgcacagcatcgtgccgtgagcccgtgggccgtgagtcgtgacgtccaagaacaagctcgtagctgtttctgcccatagtgtccgtccacctgtcgtgctcctgcagaggagggggaaaagggcgatcgagacgtgttggcgacggccgaccggcgaccgccgccgagctcgttttgccttgttgctttgtttgttatatggccctggctccgatccgggcttcgtatttcgttgacaggccttca

SEQ ID NO: 94 - DNA, 333 bp, Zea Mays
atggctctgctcctcgctctcttactcgtgctactcttggccaccggtggtcaagccgacgccgatgagccggcaacgtcacagcagcgcgctgttccggcggagcaggcgccggcgccgaagggctacgaaaccctgagggaggaaccggcaccaaccggcggtcaccgtcaccgggagatcaagatcggagcatgcttccccatcagcgacggcggcagcagcgctttctcctgctaccagcggtgcacgagcaaaggctacgccggcgggcgctgcgacaccctgcccagcggcttccccggcgactgcttctgcatcacgtacgcttga

SEQ ID NO: 95 - DNA, 1023 bp, Zea Mays
atgacctttagaaggtctattgagaccatcagcagatacttcagggaagtattgtatgttgttggtgaactgagaaatgaaatgatcttgccaccttcaactgctacaccaaccaaaattagagatagccacagatggtacccctatttcaagctatggttgacatggtgtctggggttgctagccagggggctaggcctgctctttggtggagtgccgcaatgtctgggtactggggttaagactgacaagggttttaaggaaatccaccttaactctgttgctaaaaatgtctccgagttctgtggtcaagaagtaacaggccaacaagtgtacaatcaccttcgtaagtggaggtctaggtgggtcaaagttttcaaactaaaggacattagtagcgctctttgggatgaggatacctttgtcataagcttagaagagggtcattatgttgcttacatcaaggatcacccaaaagatgttgattacctcaataggcccatagagaactatatgcctatgcaaatcatatttggaagtggggttgccactggtaggtttgcaatgggttcaaatgagcctttgggcaagccaagtgacattgttgacatcctagatgatggcattgaagtgacctcagagtttgttgatgcttccaatctaactggcaagggaaagactgttgataagggtacccctggtgactccattgataccaagcctatgtccaacttagggaagaggaagaggtacatgactgatgaagatgttgttgtgttcaatgggatgaaagaggctgtatctgatgttgctgctgttgttcgtgaaagcatccatgctgaagcagcacctgggatctacaatgttgtaatcaactgtcatgggttctctagggaggctctcatgtatgccctaaaccacatgatggagcacaaggccacctccctggtgttcctggacatgactcctgatgatcgtgacctatggctcaagactttcctaaccaagcactaccacaactga

SEQ ID NO: 96 - DNA, 1445 bp, Zea Mays
cggaagcaaaagcaggccagcacaaaaccactcgatagaaaagcccccctcaaaacccacggcgccgccgcagccgcgttcacgaagcttggggaggcgagcaccccgatccggcgaggtgccgcgagcgaggcagcgatgagaggccgtgcgtcccatctccgcgcgctcctctcgcgagcgctctctccaagccttcctcctcctggtcgcgctctgcctcaggtcactaggcccggtgcgtctccgttcggagctggattcgtggggcgcgcgcgcttcttctccatcgacgcctcggctgcgacgcagggcgggtcgaagccccctgcgccgccgccggcgggtactgcgggcggcgagggagggggtggtggtcagtctgggaaatctgaacaagcggacgccgggaaagccgtccgcggagggccggtgtcttggctcagttttctactcctgcttgtgactggaggagggataatcgtgtactacgacaaagaaaagaagcgtcacattgaaggtagattactatgaattgaagaatagaacaagtgctgtgaagcctggacaatcagtaggcactgcagccattggcggtccattcaagcttttgaatcatgatggaaaacctgttactgaaaaggatttcttgggcaaatggacgctgctttattttggatttacacactgtcctgacatttgtccagatgaactccagaaaatggctgcagcgattgacaaaattaaggaaaaggcaaaactggatgttgtgccagtttttattacagttgatcctgaaagagatactgttgagcaggttcgggactatgttaaagagttccatccagatctagtaggcctcacgggcacgacagatgaagtaagacaagttgcacgtgcttatcgagtttactatatgaagacagaggaggagggttctgactaccttgttgatcactcaattgtcatgtacctgatggacccagagatgaagtttgtcaagttttatggcaagaactacgacacagattcccttgctgacggtatcgttaaagaaattaaagagcacaagtaaacagtagttggaatgccactttgcaacgtcagccttgtttctgaatttctcccgagagttttgttaaatcaagcaaaaaccaaatggcacacgagatcatgtggcaatagctgatgacatttgaatctcgcggcggcttttatttcagcagattcgggtgcacatgttgcggttttgtgcacgtttttgtcacggcaaacttctgcgttattagcttgggacgctgttcattgctgaatgtaattttatttgcatagtttcataccagttcaatatgaaacctttttccccttctgctccctctgttttttgaatatttggtttccaataaaataagaacacatcaatttgtggagtttctaaatgaaaa

SEQ ID NO: 97 - DNA, 1432 bp, Zea Mays
cggaagcaaaagcaggccagcacaaaaccactcgatagaaaagcccccctcaaaacccacggcgccgccgcagccgcgttcacgaagcttggggaggcgagcaccccgatccggcgaggtgccgcgagcgaggcagcgatgagaggccgtgcgtcccatctccgcgcgctcctctcgcgagcgctctctccaagccttcctcctcctggtcgcgctctgcctcaggtcactaggcccggtgcgtctccgttcggagctggattcgtggggcgcgcgcgcttcttctccatcgacgcctcggctgcgacgcagggcgggtcgaagccccctgcgccgccgccggcgggtactgcgggcggcgagggagggggtggtggtcagtctgggaaatctgaacaagcggacgccgggaaagccgtccgcggagggccggtgtcttggctcagttttctactcctgcttgtgactggaggagggataatcgtgtactacgacaaagaaaagaagcgtcacattgaagaattgaagaatagaacaagtgctgtgaagcctggacaatcagtaggcactgcagccattggcggtccattcaagcttttgaatcatgatggaaaacctgttactgaaaaggatttcttgggcaaatggacgctgctttattttggatttacacactgtcctgacatttgtccagatgaactccagaaaatggctgcagcgattgacaaaattaaggaaaaggcaaaactggatgttgtgccagtttttattacagttgatcctgaaagagatactgttgagcaggttcgggactatgttaaagagttccatccagatctagtaggcctcacgggcacgacagatgaagtaagacaagttgcacgtgcttatcgagtttactatatgaagacagaggaggagggttctgactaccttgttgatcactcaattgtcatgtacctgatggacccagagatgaagtttgtcaagttttatggcaagaactacgacacagattcccttgctgacggtatcgttaaagaaattaaagagcacaagtaaacagtagttggaatgccactttgcaacgtcagccttgtttctgaatttctcccgagagttttgttaaatcaagcaaaaaccaaatggcacacgagatcatgtggcaatagctgatgacatttgaatctcgcggcggcttttatttcagcagattcgggtgcacatgttgcggttttgtgcacgtttttgtcacggcaaacttctgcgttattagcttgggacgctgttcattgctgaatgtaattttatttgcatagtttcataccagttcaatatgaaacctttttccccttctgctccctctgttttttgaatatttggtttccaataaaataagaacacatcaatttgtggagtttctaaatgaaaa

SEQ ID NO: 98 - DNA, 930 bp, Zea Mays
cggaagcaaaagcaggccagcacaaaaccactcgatagaaaagcccccctcaaaacccacggcgccgccgcagccgcgttcacgaagcttggggaggcgagcaccccgatccggcgaggtgccgcgagcgaggcagcgatgagaggccgtgcgtcccatctccgcgcgctcctctcgcgagcgctctctccaagccttcctcctcctggtcgcgctctgcctcaggtcactaggcccggtgcgtctccgttcggagctggattcgtggggcgcgcgcgcttcttctccatcgacgcctcggctgcgacgcagggcgggtcgaagccccctgcgccgccgccggcgggtactgcgggcggcgagggagggggtggtggtcagtctgggaaatctgaacaagcggacgccgggaaagccgtccgcggagggccggtgtcttggctcagttttctactcctgcttgtgactggaggagggataatcgtgtactacgacaaagaaaagaagcgtcacattgaagaattgaagaatagaacaagtgctgtgaagcctggacaatcagtaggcactgcagccattggcggtccattcaagcttttgaatcatgatggaaaacctgttactgaaaaggatttcttgggcaaatggacgctgctttattttggatttacacactgtcctgacatttgtccagatgaactccagaaaatggctgcagcgattgacaaaattagtaagtcaatttgagtcttttggtccttgggtacaagtatcttctctcaatatatcttcttgtattcatctggcactgttgtcttgcattatattgtcacttggaaactagaaggcaaataatagggtaaatgggcaagccaaaatgagatgtacatacaaggttatgtatttttgtttgactggacttggtgaaaa

SEQ ID NO: 99 - DNA, 285 bp, Zea Mays
aagaatctgactcggtgctagacgaatcgaacggaaggaagacgagaaggccccaaggtgagcgggggaacaaagaagaagatgaaggtccatgcggcggtgaagcgcctatgccggttctgcaaggtggtgaagcgccggggaatcgtcttcgccaaatgcacggccaacgccaagcacaagcagcgccagggcttctccaccatcgccgaagcagccgctgtctcgtgcgttcacctgcctccgcctccgccacagctttcgcagacgagtaagcagttctag

SEQ ID NO: 100 - DNA, 4365 bp, Zea Mays
gacgaaacggtacggtgacggctcacctcgggggtctccatgtccatggacggccctgccacctcgccggcaagcgaggtgccgttccgcatcagcttctccggccacagcggccacctccgcctcgaccctaccccgcacacgcccagccccattccggacttcgtcctgccgccggcatacccggccgagagcccgagcagcgtgaaggagtacctcgagaggaactacctcgaccccgagctgcacctccccaccgcggccgatagcgggagggtgtgggatgtcgactggtttgccctggccaggccgccgctggagccctccgccccccgcaccatgctcgcgcccgtctgggtgccgcctttccggcgcgggcaggagaagttgcaatccgcggcagagtcgcgagtgtgggaccctgagtccgtgcaaatggagatggtcgacgtgttcgattcggggaccggggggatagcgccccggatgcctggtccggcgaaggacttcgtcagggggagcatcaacaacagaccttttcgtccaggcggtctgcaggatgacgccgctgaggcggctgcgctggaaaaggcgttcccagagggtgcaaggactggtgattgggtgcgtgagctcatgagcggtggcccggcgcaggttgcgcctccagggttccgtaagggattggagctgggccagttgaaggggtatgaaagccactggaagtgtttccgggatggagaacttgtagaggagcaacctgcatcatcatcgaatgacacaatggagaagtactctgtgcagtttgatgatcttttcaagatagcgtgggaggaagatactgccaacaagttgttgaaggacggtgttgttcaacaatctgctgaaggtgaaggaatcaatgaaattggcgaacaaaaagttgatgcattgcaggatgagttcgagagtataacaacgctagatgacgagaaacaggaagttgatgtcataagaaatgttcctgaaactcaaacagacttggatcagatgttatcttctgaagtacaggatacaggcagggaaccaggtgcatcaggtgataagaagccaacacaagatggcatggtttgggcacttgttggtggggacgaggacatagtgactaacttctccaaactcgttccagatatggcaatcgagtttccatttgaattggataagttccagaaggaggctatatattatctcgagaagggtgaatcagtctttgttgcagcccatacttcagctggaaagacggttgttgctgagtatgcattcgcattagcaacgaaacattgcactaggtctgtctatactgctcctattaaaactatcagcaaccagaaatacagagatttttctgggaagtttgatgtgggacttctgacaggagatgttagcatcaggccagaggcaacttgcttaattatgactactgagatattgcgttcaatgctctacagaggcgcagacattatacgtgatattgaatgggtaatctttgatgaagtgcattatgtaaatgatgctgaaagaggtgtagtctgggaggaggtcattataatgctcccgaagcacattaacattgttcttctttcggcaacggtcccaaatactgttgaatttgctgactggattggtcggacaaagcagaagaaaattcgtgtcacatcgaccaacaaaaggcctgttccacttgagcattgcctgttctactctggagaagtgtacaaaatatgtgagagggatatgtttcttgctcaaggatttaaagaagcaaaagatgctttcaaaaagaaaaatttgaataagtttggagtgaaacctggttcaaagtcaggaacccctgcagtacgtgctggaactcaaggcaaaaatccagatacatccaacaaggggagagatcaaaagtacccaaagcaccgcaattccaattcaggagtagccacagttcaacagagctcctcagggccaaagagatttgaatctttattttggatgccacttgtgaataaccttctgaagaaatcccttgtgcctgtggtgattttttgtttctcaaagaatcgctgtgataaatcggcagatagtatgtttggcactgatctcaccagtagttcagagaaaagtgaaatacgtgtcttctgtgacaaggcattttcacgtcttaaaggatctgataggaaccttccacaggttgtaggaatacaaagccttctgcgaagaggaattggagtacaccacgctgggcttctccctattgtgaaggaagttgttgagatgctgttttgccgtggtgtaatcaaggtactgttttccactgagacatttgcaatgggtgtcaatgcaccggcaagaacggttgtgtttgattctttaagaaagtttgatggaaaagaacaccggaaattgcttccaggggaatatatacaaatggctgggcgagctggtcggagaggacttgataacattggtactgtgatcattatgtgtcgtgatgaaattcctgaagaaagcgatttgaaaaatttgatcgttggaaaaccaactcgtttggaatctcaatttcgattaacatacaccatgatactacatcttctgcgtgtggaggaactgaaggtcgaggacatgctcaagagaagttttgctgaattccacgcacaaaagaatttgcctgagaaggaaaagcttcttctgcaaatgcttcgtcaacctacaaggacaatagagtgcataaaaggagagccttctattgaggaatactacgagatgactttagatgctgaggcacacagggaatacataacagaagcaattatgcagctgcctaattctcaacagtttcttacgcctgggagattggtggttgttaaatctgattctgatgatgatcacttgcttggtgttatactgaaaaatccatctgcattgctaaagaaatatgttgttctggtattgactggtgattgcagttcatctgcactagcccctgagttcaataaaaatgaaaagggtcctgtggattttcaaggaggacaatttattgtcctgaaaggaaaacgtggcatggacgatgaatatttctcttctgttagttcacgaaaagcttcaggtgtaatcaatatcaatctaccatacaagggggatgcatctggaatgggctttgaagtaagagcaattgagaataaagaaatcattagtatatgcagcagcaaaataaagattgatcaagtcagacttcttgaggagcctaacaaaactgcatactctagaactgtccaacagcttataaaggagcaaccagatggaaccaagtatcctcctgctttagatgcaataaaagatctaaaaatgaaagacatgtatcttgttgaaagttaccgtgcatatcacatactactgcaaaaaatgtctgaaaacaagtgccatggttgtataaaactgaaggagcatatatcattgatgagggagcaaaagatgtacaaggatcagttgaatgaattgaaattccaaatgtccgacgaggcacttcaacaaatgccagagtttcaaggcagaattgatgtactaaaggtaatccactacattgattctgatctagttgtgcaacttaagggtcgggtagcatgtgaaatgaactccggtgaggagttaatatcaacagaatgtctgtttgaaaatcaattggatgacctagaacccgaagaagctgtggctattatgtctgcattcgtcttccaacaacgcaatgcttcagaaccatctcttactccaaaactggctgaagcgaagaagaggctctatgatacagccataaaattagggaagctccaatccgagttcaaggtgcctgtggaccctgaagagtatgcacgtgataatctcaagtttggccttgttgaggtcgtctacgagtgggcaaaggggacgcctttcgcagacatatgcgagctgactgatgtatccgaagggatcattgtaagaacaatcgtccgtctggacgaaacatgtagggaattcaggaatgcagcttccatcatggggaactctgcgctgttcaagaagatggaggtcgcgtctaacgctattaagcgtgacattgtgtttgcagcaagtttgtatgtcacaggaatctgatgcatgtaacctcgtagtctcccttgcttcttttgttagagaaatcgttgtgctggtggaatgctactaacctaaccttagctagaacaattgttgtggtatttttttttccagttctggattattgcttttgctagttttgcgaagttttctgaagcggcgaccagcagagtaaaggaaaatcgaaagcgggtgggattctcg

SEQ ID NO: 101 - DNA, 1724 bp, Zea Mays
atggcgaacccccgcgtcttcttcgacatgaccatcggcggtgcctcggccggccggatcgtgatggagttgtacgccaacgaggtgcccaagaccgtggagaacttccgcgcgctgtgcatgagctggaggcgccctgcacgacgtcttctaggtcagacggtcatgggcgatggtgccgacgaagaggaagcacaaaacatgtgccaccgaaccctccccaaaccctatcttcggatctcgatggcgaacccctgcgtcttcttcgacatgaccatcggcggtgccccggccggccgaatcatgatggagctgtacgccaacgaggtgcctaagactgtggagaacttctgcgcgctgtgcacgagctggaggcgccctgcacgacgtgcttccaggtcggtggtcatgggcgattgtgccgacgaagaggaagcgcacaacaggtgtcgtcgtggtcgcgaccgtcgtcaagtggaaggtgggcgacctcatgcttaccaagatgaagagcttcccggtctagccggctatgcctggggtccaaggattctgggtctaggcgggggtttcccacttaggatttggtggcggccttggaagaccggtggaagactgcaaggacatgaggagcttgatggagccagcttacgggaacatgaagaattcacaaaggtgaaaaatatcacaaaggttgaactggggagatatgagatagatacaccatacatgttaactaggctttattcacatatctctactattctatatagtcaaagcaaggtggcagaaggacccaatgttgatattggtaaatcatgcgcaaatgggtgtgctgaaatgatggagaacaatagggaacatagaattgctcttgttgctgctggattagctgctggaatcgcttcagcttgctggactggaccccgttgtgttcttccgatgatcaatcagtcaatcacaaattcaaaccatacaaatcaactcaatatccaacgtgcttctagaagtgtgttcaaggggtggagtgaggagaagatatattttgctcccacatacaagtactcttgcaactcatattcttatgctggagagactgccacatcaaagaaaaagaggagaaccccggcttggtgtgatagaatactatggcatggagatggtattgcacagttgtcctacttccggggggaatctcaattctcttaccatcgtcctgtttgtgggacatttactgttgaggttaaaaggctagatggccgatcaaagcggcgcccatcaaacaccaacattataatcgatgcagttgttaccgacaagagacaagcataactaaggtgatctagatggatgaaattgtcgacaaggccattagcatcaaaaaagattacctcaaagcatctcatgtatatccgcaaggagaagctgcactcagggaaggcattgagtgcaatagaggtgaaggaactgcgcgaagcccttgaagcgattgctgaaggtttggaccaagattcactcttgtgccagagtttggcgtagtcctcgattataaactgtgtactatgttaatgtaatgacatagtttgtatgatacagatcgtagtgatgttgtttgaagctgtttgtatgaactgtttcctactatcttgtatgaattatgatgtctgatgtagtttgtatgaactatgtcatattatgttgaatgaagctattgcatgccctta

SEQ ID NO: 102 - DNA, 1269 bp, Zea Mays
atggcgaacccccgcgtcttcttcgacatgaccatcggcggtgcctcggccggccggatcgtgatggagttgtacgccaacgaggtgcccaagaccgtggagaacttccgcgcgctgtgcatgagctggaggcgccctgcacgacgtcttctaggtcagacggtcatgggcgatggtgccgacgaagaggaagcacaaaacatgtgccaccgaaccctccccaaaccctatcttcggatctcgatggcgaacccctgcgtcttcttcgacatgaccatcggcggtgccccggccggccgaatcatgatggagctgtacgccaacgaggtgcctaagactgtggagaacttctgcgcgctgtgcacgagctggaggcgccctgcacgacgtgcttccaggtcggtggtcatgggcgattgtgccgacgaagaggaagcgcacaacaggtgtcgtcgtggtcgcgaccgtcgtcaagtggaaggtgggcgacctcatgcttaccaagatgaagagcttcccggtctagccggctatgcctggggtccaaggattctgggtctaggcgggggtttcccacttaggatttggtggcggccttggaagaccggtggaagactgcaaggacatgaggagcttgatggagccagcttacgggaacatgaagaattcacaaaggtgaaaaatatcacaaaggttgaactggggagatatgagatagatacaccatacatgttaactaggctttattcacatatctctactattctatatagtcaaagcaaggtggcagaaggacccaatgttgatattggtaaatcatgcgcaaatgggtgtgctgaaatgatggagaacaatagggaacatagaattgctcttgttgctgctggattagctgctggaatcgcttcagcttgctggactggaccccgttgtgttcttccgatgatcaatcagtcaatcacaaattcaaaccatacaaatcaactcaatatccaacgtgcttctagaagtgtgttcaaggggtggagtgaggagaagatatattttgctcccacatacaagtactcttgcaactcatattcttatgctggagagactgccacatcaaagaaaaagaggagaaccccggcttggtgtgatagaatactatggcatggagatggtattgcacagttgtcctacttccggggggaatctcaattctcttaccatcgtcctgtttgtgggacatttactgttgaggcactacagcagtctatgggtccttaa

SEQ ID NO: 103 - DNA, 1821 bp, Zea Mays
ggcggcgagcgagacacctccacacgtctctcccccttccgtttcctcccgtccctgctcacacctctgtagctgcgcccgaccgaacccctcctaccccggaatcctccccccgatgcggcgccgataagggggcgagaccggcggaagagcggggaatggcggggcgcggcgagaagcggcgccggacaggaggggcccacgaggagcccgaggaggaggaccgcatctcggaccttcccgacgtgctgcgcctgcagattctgagcctgctgccgctcaaatcggccatccgcaccggcgcgctctcctcgcgctggcgccgcctctgggcgtaccgctggccggagccgtcctcggtgagcatccgcctcccgccgggcggcggcgccgccgccgccgcggcgaccgcggccgcgctcgcggtgatcgaccgccgcgggcggcgccgcgtcgacggcttctcgctcgccttccacggcgggcagctcgcgcaggcggacctcaagcgctgcgtcgactacgcggcggcgtgcgaggccgaggacctgcacctccgcgtagacggcggcgcgggcgccggcggccgcggctcgcgcggcggcacgcgccgcccgggcatgctcaccctgcagttccccatggggtccccgctgctcgtgcgcctgtcggtgcgcgggctcaacctcacggccgtcaacaacgccatggtcgccacgctcgaggtcgtccacctccactccgtcttcctcaccgacgccgcgctgcgccggatggtcgccgcctgtccccgcctccgggaccttgacctccgctactgccgccgcctgcgccgcgtcgacttcaccaacgtcggcgtgcccaacctcaggagcttcaccgtcgtcgactgctcccgtaccaccgagctgcgggtccccgtggctccccgcctccggtccttccgcttcagcggcgccttcctctccagcaacatcctatccggcgccaaggcctctctcgagcatctctacctctgctccggcgggccagagaccggccttccagtcaccaacttgccctacgcagttcctcgcctgtcgaacctcactgtcctcaccctctgcagcattgctctccagtatgtttcttctttcacagccaaggatgtaatggagagcaacctacatggcttgagggagcttcatttgctcatgttcgggatggccaactccaaccttgctgacatctatagcttcctcaagacctgcccgtgtcctcagttagagcgcctctttgtgcagctcccgacaaacaccggtgatgcattcacggagaacttcttgaaggtggaggaggaggacccgccaaaaggtggattagaaaaccttcgcttagccaagctgacaaatttcaaggggcaccgtaatgagatgcagctagtagcatttctgcttagacagtctagtagtctgaagaaactatttttgattgctcccaaggaggatcaccctcaaggactgcgcaaggttcattcagatatgctgcctgattttcttaaaaaagaaatatcgcatctggaaagagcttcagcaaatacccagatatttttcggcgagcctgatgctcagacccacccgttgcattcggaggtctttgtcaggttttagcttgaaatgagcaaaagctgttgtagcccaattcctgctcatatagatttagatttctcgttgttagataacggacatggggaaaaaagtatctgcaaggcatacagagtttgatatatgtttcctcttttgcaattcatattactaaagaagtcctgcatagcagttgaaa

SEQ ID NO: 104 - DNA, 3254 bp, Zea Mays
gcgtggaagccatggccgctcccccaagagaaaataaaaatgtagcagtagcttgcaagcgggaaagccaagaaggcgtgtctcgcacctgtctctgaccaagacgcgcgcatggaagagaaagcgtcgggaggcggttgagatgcgtgggcgggcgggcggccaggcatccacacgtctgacgcctccccgcggtcggcgcctcggcgtggcaatataccggcgtgccccgagcgcgccggggccttcttctactcgaggcgtggcaactcccgcgtgcgcgaggccggcttccttggacctgctgccgccctcgccaccggcgatagccgcccgccgcatccattccctcgccttctcgccacggcgccaggcaaacgatgcacaagaaaaaaggagggacaaaacaaagagggaaaagaacgagcggcgtgggccgttggcccatcgggcccttggagaaattaggcaagtggggcccagtgacatggccgctctggctgtccacggccggtcagccgcgagcgagagctgggctgagctgccgtgcgcgtgctaacctggactgggcagcaggcatcagacgcatctcgcggcatctcggcatgtggaagctgtgaagaggagaagacgcggagaggagatgctgcaacagaagccgaaccgaacgaaaggaaggagagagagagagagagagagaaaaaaaaaggacggctccgcccaagggtcggaagggagggagttgccgcgccgcggccggttcgatcctttgcgcgagatcgagcttctccggttggtgttggggctggcgacatctgggatccgtcgtctctcctcgtgttcttgagcagttttccacttgcctggcaaaagaacatttgacttggaagagcaaacactggaagctttgtggtttgtcctaagtgatcctatcaagttctcataggctgcatactggtacagcattttctcctgtgttttgggccacagaagaggggggagccaaggatttttctatctcgtaagccgcggccttggtgctcatagttaccctagtctgtaagctggagattgtaaaaagccatatctgttcctctatcactgtatatagagatctacataatggacgagaggaggactattttgatggaccgttacgaaatcgggaggcagttaggccaaggaaacttcgccaaggtatactttgctcggaacctgaccgacgggcagtccgttgcgataaagatgatcgataaggacaagatcacgagggttgggctaatagtgcagataaagagggagatctctataatgaggctggtgaagcatccgaatgtcctgcagctcttcgaggtaatggctagcaagagcaagatctacttcgtattggagtacgctaaaggcggcgagctgttcaacaaagtatcaaaggcgaagctcagcgaggatgccgcgaggaggtatttccaccagctggttaatgccgtggactactgccacagccgaggcgtctaccatcgcgacttgaagccggaaaacctactcctggacgagaacgagaaccttagagtctcggacttcggtctgagcgccctgtctgaatccagaaggcacgacggcctcctacataccacgtgtggaacccctgcctatgttgctcctgaagtgcttggtaggagaggctacgatggcaccaaggcggacatatggtcctgcggagtgattctcttcgtgctcgtggctggttacctgccgttccacgacccgaatctcatcgagatgtacaggaagatctccagagctgaatacagatgccctcgctccttctccggtgagctgaaggacctgcttttcagaatgctcgatccagatcccagtaccaggatatccatttcaaggatcaagagaagcacttggtacagaaaacctatcgaggcaaacgcggcaaagatcaagcacggcacagcaagagacaccaccgtgcgcgacggtgaagccgccacggcctcgagctcgatagagtgcagtaaccggccagaggaagaccaagggtcgtcaagcctccctaacctgaacgcattcgacatcatttctctctcgaccgggtttgacctatctaacctgttcgaagaaagacacgggcggagggaggagaggttcaccaccaggcagccagtgggagcggtgtttggtaggctgaaggagctggctgagcggttgaagctgaaaatccagaagaaggagagcggggtcttgaaactggctgcgcagaaggaagggatgaaggggttcctggagctcgacgccgaggttttcgagcttgccccttcgttccttctggtcgagctgaagaaggccagcggtgacaccattgagtaccaaaggctcgtgagggaagaagtgcggcctgcgctgaaggatatggtctgggcttggcagagcgaccggcaccagcagcagcagcagcggtgcgagcagtctgtgcaaggagaggaccagcagcagccgttgtcgtctttgccgacgcagcagtagtcactgcaccaccagttgcgaccgccataaccagatcacgtcaaaactgcaccaagccgcacaggactagtaactcccacttgcatcgacgcttatgtgattgcggaattgtgtttcaggttacctgcctgctgcggtaggacctaaaacgcctacctgcctaccatttggcatttttttgtatactgtacgtacattagagtaataaacaaacatgcttaacttttcagctttcgattggaatgtgcttttcgatgtaactctgtaaccagtgtaggtacgaagtcgattagccacagggtctggccatgttgacctcacgtagccctggttcattggtgtaacagtttgttggctgcggctttacattattttgtctctatggattacggctgcgactatgtgtagctgaacaagctggtatatgatgagccctggaaacgtgtgtttactgcagctatttgcagccagtgactgttgatacaaacgacgaagtagagttggttgtttatgtaggcacgcagcatgaccataattatccatgaatcatggatagatgcacaatgtttaggaaacaggtgtgtgtggctggctggtggtgcgagaagagatgcgctgccttgatgtactgtactgggactgggagggatgcgtctcgcagtacagtctgtactatcatctctacacgcacgcacgcaggctcgacgtgtcggcggcgg

SEQ ID NO: 105 - DNA, 2637 bp, Zea Mays
caagtgatgaggggtttaggattcgtgttgctgttggtggcagctgcagcattgatcaggccatcagaagtagtaggggcagaggaggaggactgggagcttttcttgttgcagtggaggcagcataattctcttccatccccacttctcaatggggatctggtggatagaatatggtcaatttgcttaccagacatggccggtgcacaggaaatattgggcaatccactgcaatttgcttcagatcagctattgagtcagccatcagaaaatgctttgaaggcaatgctgtttctggagtttctgtctcttctttcccctgaaaaattatccagtacctatggttgcatccatgcaaactacttcggtttgggcattccacaagaactcagtgtttcactggcaacctaccttgagagccatcagctgttgcttggttcgaacttctatgcgagacggcatttggctgacaactcaattggagatgctccttccatggctccagattttgcgccgtccatgtcctctggcgatgacgtgaagcttcctcagtctgttacagaaacaccgtatgcaccttccagctcttacaacaatgaaaatccaaaccgacctcatcacagtaaacctgcacagaagcatcggggagtacctccaatttcacttctggagaagcataaagactatgttagattagtcttgatcgtggttctaccaacagcggcattctcgttcattgctgcttttctaattttctactgctgcggatgcaacaagaacaaggtctctgtcggtgagcaacgagatgatcatcctcttcttcacatgcagttggctaatgtacctggttcatcacccgatgcccgtgtttctgccagtcaccttaacaaggataatcgaagtcattctggagtcagcatgagtcggtgcttttcatgctgttttaaaagatccactgatgccacaccatcttcagaagtgattggaggaacaccagagaataatgtcacaagtgatgctcctaaaccgatgtcgcctccagctcctccacctttgccacctccgatcaagaaggctcctcctcccccacctggacctcccagaggttctaaagcaagacttgctcagctgtcacctgttgagtcaagtcgttctgaaggatcatctgccagcgagcagaccagcgaatcatctgaagcagaagttaatgctccaagaaccaagcttcgacctttctattgggacaaagttcttgctaatcctgatcagtcaatggcatggcatgatatcaaattcggttcttttcatgtgaatgaagatatgatagaggaattgtttggttatagtggtggaagcagaaataaccttaaggataaggaactcccctctgcggatcctgcatctcagcacatttctcttctcaatgttaagaaatcatgcaacctggcagttgttttaaaggcaatgaatatcagggtacaagacattcatgacgctcttattgaagggaacgaacttccaagggtgcttcttgagacaatcttgagaatgaaaccaactgacgaggaggaacagaatctcaggctttataacggggatttctcgcagctaggccttgcagaacaagtgatgaaggcattaattgacacgccttttgctttcaagagggttgacatgttgcttttcatgtcctccttgcaagaagatgcttcaagtctcagggattcgttccaccaattggaggccgcttgtggggaactgaagcaccgcctttttctcaagttactagaagccgtgctcaaaactggaaaccgtttgaatgatggaaccttccgtggtggtgctaatgcattcaagcttgacactctcctgaagctatcagatgtcaagggtgctgatggaaagaccacattgctgcactttgttgtgcaggagattgttcggtccgaaggtgtccgcgaagcaaggctagccatggaaaacggaagaagtccagctcatagtgcttcagatgacacttccaatggatctcttgaagaggacggtgatcactactccaaccgcggacttagcattgtgtcaggacttagcagtgagatggacaacgtcaagagggtagccgcactggatgctgagcctctgtttgccactgtggtgaccctcagacaagagttgctgaaatcaagggagttcctgaatgaaattgcgacagtagaagagacgagtggattcagacgttcgttggaaagctttgtggaacacgcggataatgagacggggtttttgttgaaagaagagaagaggttgagatcgttggtgaagaaaacaatccggtatttccatggaaacgactctaaagacgacggtttccggttgtttgtggttgtgagagatttcttggtgatgctagataaggcgtgcaaggaggtcggggcatcacagaagggtacgaataaatcacgaagcagtggcagtggcagtggcaatggcaatggcaaccctacgttcccgtcaatcctacaggagcaacagttccctgctgttattgatggccattcagatagttcacatactagcaattgacgatgagatactaacctttttttgtaaagaaaaaaaaatccgttttggagagga

SEQ ID NO: 106 - DNA, 2382 bp, Zea Mays
attcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaagatgcagatctttgtgaaaaccctgactggcaagactatcaccctcgaggtggagtcgtctgacaccattgacaacgttaaggccaagatccaggacaaggagggcatccccccagaccagcagcggctcatctttgctggcaaacagcttgaggacgggcgcacgcttgctgactacaacatccagaaggagagcaccctccaccttgtgctccgtctcaggggaggcatgcagatctttgtgaaaaccctgaccggcaagactatcaccctcgaggtggagtcctctgacaccattgacaacgtcaaggccaagatccaggacaaggagggcatccctccagaccagcagcggctcatctttgctgggaagcagcttgaggacgggcgcacgcttgccgactacaacatccagaaggagagcaccctccacttggtgctgcgcctcaggggaggcatgcagatcttcgtgaagaccctgaccggcaagactatcaccctcgaggtggagtcttcagacaccatcgacaacgtcaaggccaagatccaggacaaggagggcattcccccagaccagcagcggctcatctttgctggaaagcagcttgaggacgggcgcacgcttgccgactacaacatccagaaggagagcaccctccacttggtgctgcgcctcaggggaggcatgcagatcttcgtgaagaccctgaccggcaagactatcaccctcgaggtggagtcttcagacaccatcgacaatgtcaaggccaagatccaggacaaggagggcatcccaccggaccagcagcgtttgatcttcgctggcaagcagctggaggatggccgcacccttgcggattacaacatccagaaggagagcaccctccacctggtgctccgtctcaggggtggtatgcagatctttgtgaagacactcactggcaagacaatcacccttgaggtggagtcttcggataccattgacaatgtcaaggccaagatccaggacaaggagggcatcccacccgaccagcagcgcctcatcttcgccggcaagcagctggaggatggccgcaccctggcggattacaacatccagaaggagagcactctccacctggtgctccgcctcaggggtggcatgcagatttttgtgaagacattgactggcaagaccatcaccttggaggtggagagctctgacaccattgacaatgtgaaggccaagatccaggacaaggagggcattcccccagaccagcagcgtctgatctttgcgggcaagcagctggaggatggccgcactctcgcggactacaacatccagaaggagagcacccttcaccttgttctccgcctcagaggtggtatgcagatctttgtaaagaccctgactggaaaaaccataaccctggaggttgagagctcggacaccatcgacaatgtgaaggcgaagatccaggacaaggagggcatccccccggaccagcagcgtctgatcttcgccggcaaacagctggaggatggccgcaccctagcagactacaacatccaaaaggagagcaccctccaccttgtgctccgtctccgtggtggtcagtaagtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctgcaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgat

SEQ ID NO: 107 - DNA, 750 bp, Zea Mays
aacctcgtgttgttcggagcgcacacacacacaaccagatctcccccaaatccacccgtcggcacctccgcttcaagatgcagatctttgtgaaaaccctgactggcaagactatcaccctcgaggtggagtcgtctgacaccattgacaacgttaaggccaagatccaggacaaggagggcatccccccagaccagcagcggctcatctttgctggcaaacagcttgaggacgggcgcacgcttgctgactacaacatccagaaggagagcaccctccaccttgtgctccgtctcaggggaggcatgcagatctttgtgaaaaccctgaccggcaagactatcaccctcgaggtggagtcctcggacaccatcgacaatgtgaaggcgaagatccaggacaaggagggcatccccccggaccagcagcgtctgatcttcgccggcaaacagctggaggatggccgcaccctagcagactacaacatccaaaaggagagcaccctccaccttgtgctccgtctccgtggtggtcagtaagtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgtt

SEQ ID NO: 108 - DNA, 1756 bp, Zea Mays
aacctcgtgttgttcggagcgcacacacacacaaccagatctcccccaaatccacccgtcggcacctccgcttcaagatgcagatctttgtgaaaaccctgactggcaagactatcaccctcgaggtggagtcgtctgacaccattgacaacgttaaggccaagatccaggacaaggagggcatccccccagaccagcagcggctcatctttgctggcaaacagcttgaggacgggcgcacgcttgctgactacaacatccagaaggagagcaccctccaccttgtgctccgtctcaggggaggcatgcagatctttgtgaaaaccctgaccggcaagactatcaccctcgaggtggagtcctctgacaccattgacaacgtcaaggccaagatccaggacaaggagggcatccctccagaccagcagcggctcatctttgctgggaagcagcttgaggacgggcgcacgcttgccgactacaacatccagaaggagagcaccctccacttggtgctgcgcctcaggggaggcatgcagatcttcgtgaagaccctgaccggcaagactatcaccctcgaggtggagtcttcagacaccatcgacaacgtcaaggccaagatccaggacaaggagggcattcccccagaccagcagcggctcatctttgctggaaagcagcttgaggacgggcgcacgcttgccgactacaacatccagaaggagagcaccctccacttggtgctgcgcctcaggggaggcatgcagatcttcgtgaagaccctgaccggcaagactatcaccctcgaggtggagtcttcagacaccatcgacaatgtcaaggccaagatccaggacaaggagggcatcccaccggaccagcagcgtttgatcttcgctggcaagcagctggaggatggccgcacccttgcggattacaacatccagaaggagagcaccctccacctggtgctccgtctcaggggtggtatgcagatctttgtgaagacactcactggcaagacaatcacccttgaggtggagtcttcggataccattgacaatgtcaaggccaagatccagaaggagagcactctccacctggtgctccgcctcaggggtggcatgcagatttttgtgaagacattgactggcaagaccatcaccttggaggtggagagctctgacaccattgacaatgtgaaggccaagatccaggacaaggagggcattcccccagaccagcagcgtctgatctttgcgggcaagcagctggaggatggccgcactctcgcggactacaacatccagaaggagagcacccttcaccttgttctccgcctcagaggtggtatgcagatctttgtaaagaccctgactggaaaaaccataaccctggaggttgagagctcggacaccatcgacaatgtgaaggcgaagatccaggacaaggagggcatccccccggaccagcagcgtctgatcttcgccggcaaacagctggaggatggccgcaccctagcagactacaacatccaaaaggagagcaccctccaccttgtgctccgtctccgtggtggtcagtaagtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaa

SEQ ID NO: 109 - DNA, 1892 bp, Zea Mays
accctactccatcttctcgtgttgttcggcgcacgcggagacagcccgcgatcccgatcccgatccttcttcacgcgaatctcgacgatcccccccttccttccttcaagaaggagagcaccctccacctggtgctccgcctgaggggtggcaatggtaatgcagatctttgtgaagaccttgactgccatatgcggttcaactagccctccgaccccctctcgagagttccgctccaccgcggcgaaggaagtggcggaggaggaggatccgcgcctgcgctgggccttcgtgcggaaggtgtacgcggccccccgctgccgtctggcccacgtacatcgccatcctcctatccctgtccccgctcggactcttcctcgctaccgccgtgtctgcggatctggccaagtagcccggtaggaagcgccgtgggaggagacaggcgaggcgttcgaccgccgccggcagcttaggacgtaccacgtctctgttctatgggttcacgagtttcggggccctacatggattctccgcctccgcctccgcctcgtccgccatcgccgccgcgacaccctcctcaccctcagggcgagcgtcacgtcggcggggagatgctgtaccaggacacagaccataggctccgcgcgctggtcgggagcgccgagggcttcggccgccacgccatcgggggcctctacggggccatccaccgcgtcacgtcgctccaagacgacgggcccgggagtctgagggaggcgtgccgggcggaggagcccctgtggatcgtcttcgaggtgtccggcaccatccacctccactcctacctccgcgtctcctcgtacaagaccatcgacgggcgcggccagcgcgtggtgctcaccggcaaggggctccggctcaagtcatgccatcacgtcatcatctgcaacctggtgttagaaggaggccgtgggcacgacgtggatggcatccaggtcaagcccgactccaccaacatctggatcgaccgctgcaccctcgccgactacgatgacggcctcatcgacatcacgcgccagagcacagacatcacagtctcaagatgccattttatgcggcacgacaagacgatgctcatcggtgccgaccccacgcacgtcggcgaccgctgcatcagggtcaccatccaccactgcttcttcgacggcacgcgacagaggcacccccgcctccgcttcggaaaggttcacctctacaacaactacacgcgcagctggggcatctacgccgtctgcgcaggcgtagaggcccagatcgtgtcccagtgcaacatctacgaggcaggtggagggcccccaaagaagacaactgtattcaagtacatgccggagaaggccggcgaccgagaggacgtggtggcagggtcgatcagctcggaaggggacgccttcctcaatggcgcgctgccctgcctgatcgataaccctgggtctgtcttcaggccagaggagtactaccagcagtggaccatggagccagcgtcgccggcgctcaaggacataatacagctctgcgcaggatggcagccggtgccccgccccccggatgatcgctgactttcatcattctgatatgctgcagctcgcttctgtaagaatattcgtttcacggaagcactgcatttgtatgcatctcatcctaggtaattcaacatttgtttcatggtagagtggcatttgtatgccactcctcttcatctgccccctctctgaaatgtagtagaaaagttgttatggttttctatttgtgtctttatttatggtacatacaattcccaatgtaaagatatttctctcgtccatagcagtacaatagcttttagttgtgaatgctactcgtatgtcttatactag

SEQ ID NO: 110 - DNA, 2629 bp, Zea Mays
caaatctgtcaacggggactctcatcctcttgctcatagaaagaactgcagtgttacaggtaggtaattactagagtactactactaagtaaatctgtcaaaggcagtcatggcatccatatccttcacatcagtactgggagtggcacacgcaccgcacacatactactacatctactagtatgtagtggagtgcttgaaaggcataagcgaattttcttcttgtttggtctacgtccatttgcttgtccactaaccggctagtttactctgctttttgggttttccacgtctctacaattgtgactgttagagcaactccagtagttctctaaaaaatagcttgctaaaatcatgtttagcaagttgctaaatagctattggaagtaaaaaataacttagtttccaatagttgctcatatttaggaagtagttcgattttgaatctagctttagcggccctgtccctatgagatctgcctgataataaggttgagagcagaggatatgagggcggaagaaaaaaggtcggtcgatatgaattatggatgagtggtggtccggtgacgcaacttatgagaaagttaggttcgacggtgaaggagaaacttgcgtcatacgtgtttgacctagctacctcattatgctagaaaataaaaaagagtgtgttataactggctatctcactgtataggaaaggtaaaaataatcacgctagtgtgaagaaattgacgtcaactgtatttagggagttcctaccgagttgctaaatgtggagagtaaatagagttgaatagcaactaactaaatttagcaagtctatttagagaaccattggagaagtatttttctgttcacttcttaaatttaagatttagagagttatttagagaactattgaagttgctcttagaccacctataattgtgactgttgaccacctatagatgcggttcaactagccctccgaccccctctcgagagttccgctccaccgcggcgaaggaagtggcggaggaggaggatccgcgcctgcgctgggccttcgtgcggaaggtgtacgcggccccccgctgccgtctggcccacgtacatcgccatcctcctatccctgtccccgctcggactcttcctcgctaccgccgtgtctgcggatctggccaagtagcccggtaggaagcgccgtgggaggagacaggcgaggcgttcgaccgccgccggcagcttaggacgtaccacgtctctgttctatgggttcacgagtttcggggccctacatggattctccgcctccgcctccgcctcgtccgccatcgccgccgcgacaccctcctcaccctcagggcgagcgtcacgtcggcggggagatgctgtaccaggacacagaccataggctccgcgcgctggtcgggagcgccgagggcttcggccgccacgccatcgggggcctctacggggccatccaccgcgtcacgtcgctccaagacgacgggcccgggagtctgagggaggcgtgccgggcggaggagcccctgtggatcgtcttcgaggtgtccggcaccatccacctccactcctacctccgcgtctcctcgtacaagaccatcgacgggcgcggccagcgcgtggtgctcaccggcaaggggctccggctcaagtcatgccatcacgtcatcatctgcaacctggtgttagaaggaggccgtgggcacgacgtggatggcatccaggtcaagcccgactccaccaacatctggatcgaccgctgcaccctcgccgactacgatgacggcctcatcgacatcacgcgccagagcacagacatcacagtctcaagatgccattttatgcggcacgacaagacgatgctcatcggtgccgaccccacgcacgtcggcgaccgctgcatcagggtcaccatccaccactgcttcttcgacggcacgcgacagaggcacccccgcctccgcttcggaaaggttcacctctacaacaactacacgcgcagctggggcatctacgccgtctgcgcaggcgtagaggcccagatcgtgtcccagtgcaacatctacgaggcaggtggagggcccccaaagaagacaactgtattcaagtacatgccggagaaggccggcgaccgagaggacgtggtggcagggtcgatcagctcggaaggggacgccttcctcaatggcgcgctgccctgcctgatcgataaccctgggtctgtcttcaggccagaggagtactaccagcagtggaccatggagccagcgtcgccggcgctcaaggacataatacagctctgcgcaggatggcagccggtgccccgccccccggatgatcgctgactttcatcattctgatatgctgcagctcgcttctgtaagaatattcgtttcacggaagcactgcatttgtatgcatctcatcctaggtaattcaacatttgtttcatggtagagtggcatttgtatgccactcctcttcatctgccccctctctgaaatgtagtagaaaagttgttatggttttctatttgtgtctttatttatggtacatacaattcccaatgtaaagatatttctctcgtccatagcagtacaatagcttttagttgtgaatgcta

SEQ ID NO: 111 - DNA, 1748 bp, Zea Mays
cgcacgcggagacagcccgcgatcccgatcccgatccttcttcacgcgaatctcgacgatcccccccttccttccttcaagccctccgaccccctctcgagagttccgctccaccgcggcgaaggaagtggcggaggaggaggatccgcgcctgcgctgggccttcgtgcggaaggtgtacgcggccccccgctgccgtctggcccacgtacatcgccatcctcctatccctgtccccgctcggactcttcctcgctaccgccgtgtctgcggatctggccaagtagcccggtaggaagcgccgtgggaggagacaggcgaggcgttcgaccgccgccggcagcttaggacgtaccacgtctctgttctatgggttcacgagtttcggggccctacatggattctccgcctccgcctccgcctcgtccgccatcgccgccgcgacaccctcctcaccctcagggcgagcgtcacgtcggcggggagatgctgtaccaggacacagaccataggctccgcgcgctggtcgggagcgccgagggcttcggccgccacgccatcgggggcctctacggggccatccaccgcgtcacgtcgctccaagacgacgggcccgggagtctgagggaggcgtgccgggcggaggagcccctgtggatcgtcttcgaggtgtccggcaccatccacctccactcctacctccgcgtctcctcgtacaagaccatcgacgggcgcggccagcgcgtggtgctcaccggcaaggggctccggctcaagtcatgccatcacgtcatcatctgcaacctggtgttagaaggaggccgtgggcacgacgtggatggcatccaggtcaagcccgactccaccaacatctggatcgaccgctgcaccctcgccgactacgatgacggcctcatcgacatcacgcgccagagcacagacatcacagtctcaagatgccattttatgcggcacgacaagacgatgctcatcggtgccgaccccacgcacgtcggcgaccgctgcatcagggtcaccatccaccactgcttcttcgacggcacgcgacagaggcacccccgcctccgcttcggaaaggttcacctctacaacaactacacgcgcagctggggcatctacgccgtctgcgcaggcgtagaggcccagatcgtgtcccagtgcaacatctacgaggcaggtggagggcccccaaagaagacaactgtattcaagtacatgccggagaaggccggcgaccgagaggacgtggtggcagggtcgatcagctcggaaggggacgccttcctcaatggcgcgctgccctgcctgatcgataaccctgggtctgtcttcaggccagaggagtactaccagcagtggaccatggagccagcgtcgccggcgctcaaggacataatacagctctgcgcaggatggcagccggtgccccgccccccggatgatcgctgactttcatcattctgatatgctgcagctcgcttctgtaagaatattcgtttcacggaagcactgcatttgtatgcatctcatcctaggtaattcaacatttgtttcatggtagagtggcatttgtatgccactcctcttcatctgccccctctctgaaatgtagtagaaaagttgttatggttttctatttgtgtctttatttatggtacatacaattcccaatgtaaagatatttctctcgtccatagcagtacaatagcttttagttgtgaatgcta

SEQ ID NO: 112 - DNA, 1763 bp, Zea Mays
cgcacgcggagacagcccgcgatcccgatcccgatccttcttcacgcgaatctcgacgatcccccccttccttccttcaagatgcggttcaactagccctccgaccccctctcgagagttccgctccaccgcggcgaaggaagtggcggaggaggaggatccgcgcctgcgctgggccttcgtgcggaaggtgtacgcggccccccgctgccgtctggcccacgtacatcgccatcctcctatccctgtccccgctcggactcttcctcgctaccgccgtgtctgcggatctggccaagtagcccggtaggaagcgccgtgggaggagacaggcgaggcgttcgaccgccgccggcagcttaggacgtaccacgtctctgttctatgggttcacgagtttcggggccctacatggattctccgcctccgcctccgcctcgtccgccatcgccgccgcgacaccctcctcaccctcagggcgagcgtcacgtcggcggggagatgctgtaccaggacacagaccataggctccgcgcgctggtcgggagcgccgagggcttcggccgccacgccatcgggggcctctacggggccatccaccgcgtcacgtcgctccaagacgacgggcccgggagtctgagggaggcgtgccgggcggaggagcccctgtggatcgtcttcgaggtgtccggcaccatccacctccactcctacctccgcgtctcctcgtacaagaccatcgacgggcgcggccagcgcgtggtgctcaccggcaaggggctccggctcaagtcatgccatcacgtcatcatctgcaacctggtgttagaaggaggccgtgggcacgacgtggatggcatccaggtcaagcccgactccaccaacatctggatcgaccgctgcaccctcgccgactacgatgacggcctcatcgacatcacgcgccagagcacagacatcacagtctcaagatgccattttatgcggcacgacaagacgatgctcatcggtgccgaccccacgcacgtcggcgaccgctgcatcagggtcaccatccaccactgcttcttcgacggcacgcgacagaggcacccccgcctccgcttcggaaaggttcacctctacaacaactacacgcgcagctggggcatctacgccgtctgcgcaggcgtagaggcccagatcgtgtcccagtgcaacatctacgaggcaggtggagggcccccaaagaagacaactgtattcaagtacatgccggagaaggccggcgaccgagaggacgtggtggcagggtcgatcagctcggaaggggacgccttcctcaatggcgcgctgccctgcctgatcgataaccctgggtctgtcttcaggccagaggagtactaccagcagtggaccatggagccagcgtcgccggcgctcaaggacataatacagctctgcgcaggatggcagccggtgccccgccccccggatgatcgctgactttcatcattctgatatgctgcagctcgcttctgtaagaatattcgtttcacggaagcactgcatttgtatgcatctcatcctaggtaattcaacatttgtttcatggtagagtggcatttgtatgccactcctcttcatctgccccctctctgaaatgtagtagaaaagttgttatggttttctatttgtgtctttatttatggtacatacaattcccaatgtaaagatatttctctcgtccatagcagtacaatagcttttagttgtgaatgcta

SEQ ID NO: 113 - DNA, 1737 bp, Zea Mays
gagagttccgctccaccgcggcgaaggaagtggcggaggaggaggatccgcgcctgcgctgggccttcgtgcggaaggtgtacgcggccccccgctgccgtctggcccacgtacatcgccatcctcctatccctgtccccgctcggactcttcctcgctaccgccgtgtctgcggatctggccaagtagcccggtaggaagcgccgtgggaggagacaggcgaggcgttcgaccgccgccggcagcttaggacgtaccacgtctctgttctatgggttcacgagtttcggggccctacatggattctccgcctccgcctccgcctcgtccgccatcgccgccgcgacaccctcctcaccctcagggcgagcgtcacgtcggcggggagatgctgtaccaggacacagaccataggctccgcgcgctggtcgggagcgccgagggcttcggccgccacgccatcgggggcctctacggggccatccaccgcgtcacgtcgctccaagacgacgggcccgggagtctgagggaggcgtgccgggcggaggagcccctgtggatcgtcttcgaggtgtccggcaccatccacctccactcctacctccgcgtctcctcgtacaagaccatcgacgggcgcggccagcgcgtggtgctcaccggcaaggggctccggctcaagtcatgccatcacgtcatcatctgcaacctggtgttagaaggaggccgtgggcacgacgtggatggcatccaggtcaagcccgactccaccaacatctggatcgaccgctgcaccctcgccgactacgatgacggcctcatcgacatcacgcgccagagcacagacatcacagtctcaaggtcttttcactcttccttcccctgtaaatcttattactatattgcaaaaaaaaaaactgctatccgatgcggaaattttgtagtaatcgatatattagcttcacgattgaaccaaccaattaacaaattactgcacgcagatgccattttatgcggcacgacaagacgatgctcatcggtgccgaccccacgcacgtcggcgaccgctgcatcagggtcaccatccaccactgcttcttcgacggcacgcgacagaggcacccccgcctccgcttcggaaaggttcacctctacaacaactacacgcgcagctggggcatctacgccgtctgcgcaggcgtagaggcccagatcgtgtcccagtgcaacatctacgaggcaggtggagggcccccaaagaagacaactgtattcaagtacatgccggagaaggccggcgaccgagaggacgtggtggcagggtcgatcagctcggaaggggacgccttcctcaatggcgcgctgccctgcctgatcgataaccctgggtctgtcttcaggccagaggagtactaccagcagtggaccatggagccagcgtcgccggcgctcaaggacataatacagctctgcgcaggatggcagccggtgccccgccccccggatgatcgctgactttcatcattctgatatgctgcagctcgcttctgtaagaatattcgtttcacggaagcactgcatttgtatgcatctcatcctaggtaattcaacatttgtttcatggtagagtggcatttgtatgccactcctcttcatctgccccctctctgaaatgtagtagaaaagttgttatggttttctatttgtgtctttatttatggtacatacaattcccaatgt

SEQ ID NO: 114 - DNA, 328 bp, Zea Mays
accctactccatcttctcgtgttgttcggcgcacgcggagacagcccgcgatcccgatcccgatccttcttcacgcgaatctcgacgatcccccccttccttccttcaagaaggagagcaccctccacctggtgctccgcctgaggggtggcaatggtaatgcagatctttgtgaagaccttgactgccatgtatgataccgtctttgaagtatttgtattgtctgtcgtgactaagtttgtttcgtggaccggttgtcttctaccctacccaaaactacagtgtggcagcaaatgatgaataaatgtgatgtttgaatttaaaaata

SEQ ID NO: 115 - DNA, 700 bp, Zea Mays
accctactccatcttctcgtgttgttcggcgcacgcggagacagcccgcgatcccgatcccgatccttcttcacgcgaatctcgacgatcccccccttccttccttcaaggtacggcgaatcggcgatcatcctcccgctttcccttctcctctaggtataatgatttgttataggttatggggacttttgagtcatcgggtcgatctgacgatttgctatgggtgctctgagtactcgacctgggaactgtggggcgcttgtaggcggcgcagagttgggtctcgtcgttgtaatgattccatcggctcgttgcgtagggtttgatctgcctgtcgttttcttttcttttaattaaatttctgatgcacagtcatgtattgatctggtttggtgttcctagatgcgtgtaataaatggggaaaaaaccatgtcgtaataaaatcaatttatttttaataaaaaaaatctgaattctggctctagtgaataaatggatagagcctggctctaattctggtaaaataaaaagacaacgagcttaacttcttaattggtcaattggaagggttctccgatctaattagacgttgaaaatatattgcaagattacttcacttctttaaattgccaagaaaccataaatttaccattgtgattggggctacttttttttaacctttagcctttgtgaaatttaa

SEQ ID NO: 116 - DNA, 2110 bp, Zea Mays
agaaagattcgcccatcgcccactggccactgcgcactgggcacggactggcaggcgaagaacctaagcagaacctaccatgtcaccggcggcgaggcgcatcctgctcgccgtcgccgcccgtcgccgccgcttctccacggacgcagcggcgtcggacccgtcccgggcgtcgcagcagctgcccaggggcaagcgatgggatgcggtggtgatcggcggcggccacaacggcctcgtcgcggccgcctacctcgcccgcgctggccgctccgtcgccgtgctggagcgccggggcgtcctgggtggcgcggcggtctcggagtcggaccttgtccccggattccgcttctcccgctgcagctacctcctcagcctccttcgccccgccatcctccgcgacctggagctggagaggcacgggctgaagctgctgccgcggagcccttcgtcgtttacgccatgccttgacggcagatacctgcttcttggccccgatgctgagctaaactactcagagatcagcaagttctctaggaaggatgcagtggcatacccaagatacgaggagaagctggagaacttctgcaagctcatggactttgtcatagactcagctccacccgagctgaggcaggaggcccacttctcgatggttgacaggatgaagcatagggttgagaagtcagcattctggggccaccttcttcggcatgtgatgcagcaggggcagaagaacatggtggaattctttgacctactcctttctccggcatcgaaaatcttgaacacctggtttgagagtgaggttttgaaggccactcttgcaactgacgccgtgataggagctatggctggtgtgcacactccaggttctggatatgttcttctacaccatgtcatgggggagactggtggtcagcgtggtgtttgggcgtatgtccaaggtggtatgggttcagtgtcatcagctataagcaaagcagctcttgaagcaggagtgcagattgtaacaaatgccgaggtttcccaagtaatggttaatgaaactagtggaatggtagaaggggtagctttggttgatggaacagaggtgcactcgccagttgttctctcaaatgccacaccatacaaaacatttgtggacctagtaccttctagtgttcttccggaggacttcctctgtgcaattaaggcagcagattacagctctgcaacaacaaagattaatgtggctgtcgacagactgccacagttccagtgttgcaacaccaatcttgaaggtggcccagagcacatgggcacaatacacattgggtccgaaagcatggaggaaattgacgttgcatacagggaagcagcagacggcatctcgtccaaaagacctgttatagaaatgacaattccttctgttttggataagaccatctctccgccaggtcagcatgttattaatctctttgttcagtacacaccctacaaactttcagaaggcagctggcaggattctaatgtcagaaaagcctttgctgagcgatgcttctctttgattgatgagtacgcgccaggcttcagctcatcggtggtaggctacgatatgctgactccgcctgatcttgaaagagagttcggcctaacagggggaaacattttccacggcgcaatgggcttggattctctcttcctcatgaggcctgccaagggatggtcggattacagaactcctgtgaaggggctgtacctctgcgggagtggcgcacacccaggtggcggggtgatgggcgcgccaggacgcaacgccgccgccgttgttttggaggaccacgtgaagacaaagtaggtgtagtgtagctcgctggaaaccaagatggcatttttatcatcaggagaaaatctttgatgccatggtgctgttttagtgcctttcttttcttttcctttttggagaattattgtcgcaatccatagtcggagaacttatatcatgtgaagactcgtgtaacaaatcctcactaacatttctgtccctgtccggcgggaaattggaactgtggtaaaatgtggacccatctctttgaaccacaaaggccctatgggcttattttgtgat

SEQ ID NO: 117 - DNA, 1015 bp, Zea Mays
gatctaccagctctagtgttgctagaataactaagcaaatatcttttatgctgatatctggtttcttttgcaggacctagtaccttctagtgttcttccggaggacttcctctgtgcaattaaggcagcagattacagctctgcaacaacaaagattaatgtggctgtcgacagactgccacagttccagtgttgcaacaccaatcttgaaggtggcccagagcacatgggcacaatacacattgggtccgaaagcatggaggaaattgacgttgcatacagggaagcagcagacggcatctcgtccaaaagacctgttatagaaatgacaattccttctgttttggataagaccatctctccgccaggtcagcatgttattaatctctttgttcagtacacaccctacaaactttcagaaggcagctggcaggattctaatgtcagaaaagcctttgctgagcgatgcttctctttgattgatgagtacgcgccaggcttcagctcatcggtggtaggctacgatatgctgactccgcctgatcttgaaagagagttcggcctaacagggggaaacattttccacggcgcaatgggcttggattctctcttcctcatgaggcctgccaagggatggtcggattacagaactcctgtgaaggggctgtacctctgcgggagtggcgcacacccaggtggcggggtgatgggcgcgccaggacgcaacgccgccgccgttgttttggaggaccacgtgaagacaaagtaggtgtagtgtagctcgctggaaaccaagatggcatttttatcatcaggagaaaatctttgatgccatggtgctgttttagtgcctttcttttcttttcctttttggagaattattgtcgcaatccatagtcggagaacttatatcatgtgaagactcgtgtaacaaatcctcactaacatttctgtccctgtccggcgggaaattggaactgtggtaaaatgtggacccatctctttgaaccacaaa

SEQ ID NO: 118 - DNA, 926 bp, Zea Mays
ctgcaagtctgcaacaacaactcaacaaagacgtgcacacacagtcatacacaagtagagcgacagtagagatacctaccgtctcctatattgtgtgtgtttgtcgtgtcatctcctatctcgatcatggcgcaggcgcacgtggcggcgaggttcatgacggaggtggcgccgccgcaggtggtgtcggtcatgcggcagaggaggaagaaggtgccgaggagcctggacaccatcgccgaggacgacgacagggagcagcagctggcgtgcgggccaccgtcggaccacggcttcgcggcggcgtggtcgctgccgacgccgacgccgacgccgccgcagccacgggagcgcgcgggcgggttcgtggcgaggggcctcgtcggcaagtacttgtcggacgcccacgacggctgccaggccagtggctgggagggtgggcacatgctaggccaccggcgagccgtgcatgcgcaggagctgcacgaggtcggagcttgaagaggggggagagagaacatcatctagctgcatgcagtgagattgttttgggctgggtccgcccctgtttgtaccacttccacacgtgcgctcatgcatgcatgataatttaattacctttagctttattacgcgtcaagtggagagcatatcacaagtagaaaagcttacacacggtttcagtatcaagtgtacaataaggttatttgtagtggcgtttttttaaaaaaaacgcaaggataaatcatatttatacatgcggttccttaaaaaatcgtcactagaaatccataatttctaaatattgttttcttaaagaaccatcactagaatcatttttatcttaaattttttaagttttttaaatgatctcgtatgaaaaaaaacaacaacataaaagctatatatctctaaaagttataaaa

SEQ ID NO: 119 - DNA, 1134 bp, Zea Mays
cacaagagcaagagcaagagcaattactgcaaaaccctaaattagctacgtatagcttctcttctcacccatggccaattcaagcaactacggccttgggcttgcttgcttcttcgccattgctgctgcggtcgccggcgggacgcagttcatggtcggcggcgccaatggctggagcgtgcccaccgccggcgccgagcccttcaacacttgggcggagaggacgaggtttcagatcggagactccctagtgttcgtgtaccccaaggaccaggactcggtgctgctggtggagccggcggactacaacgcctgcgacacgtcgtcgtacgtgaggaagttcgacgacggcgacaccgtggtcacgctcgaccgctccggcccgctcttcttcatcagcggcgtcgaggccaactgccgcgccaacgagaagctcatcgtcatggtcctcgccgcccgcagcaacggcaacggcaccggcggcggcgcgcaggctccgagcacggcgccgcagccggcgtcaccggcggcatcgccccctcccgccagctccaccccgcccccgccgtcgtcgcccgctcccaagggcgcgtcgccgcccccggcctctgctcccacaacgacaccgggtacgccgccgccccctgctccgagcgcgtcgtcgcctgctccggcgtcgtcaaccccaccgccgccatctgccccgcaggcaccgccgccgccccctgcttcgagcgcgtcgtcgcctgctccggcattgacgaccccgccgccgccatctgccacggcgaatgccccgcaggcaccgccgccgccctcggcgagctctccgtctccgagcgcacatggagcaacggctagctcgacgggcacgccatcgtcgcctcccgccggcgccgaggtcaagaacggcgccgccctcacggtggccacgggcttggccagctccttcggggcctgcatccttggctacgccatgcttgctctatgaagaagtgaagtggaccgtggacacgatgcacggaagacccgagtaaatacagtatgtctatacatgttaactgaagacatgcgatttgtgcatgctttcgttttccgccgcatgaataagaaatcaacaattctttatgcctc

SEQ ID NO: 120 - DNA, 654 bp, Zea Mays
atgcaggccccgaaggagctggccaagcccgtggccaccgtgagggcggcgccgttcttgacctcggcgccggcgggaggcgacgatggcgtgcccgtcgagctagccgttgctccatgtgcgctcggagacggagagctcgccgagggcggcggcggtgcctgcggggcattcgccgtggcagatggcggcggcggggtcgtcaatgccggagcaggcgacgacgcgctcgaagcagggggcggcggcggtgcctgcggggcagatggcggcggtggggttgacgacgccggagcaggcgacgacgcgctcggagcagggggcggcggcgtacccggtgtcgttgtgggagcagaggccgggggcggcgacgcgcccttgggagcgggcgacgacggcgggggcggggtggagctggcgggagggggcgatgccgccggtgacgccggctgcggcgccgtgctcggagcctgcgcgccgccgccgggagtctccgatctgaaacctcgtcctctccgcccaagtgttgaagggctcggcgccggcggtgggcacgctccagccattggcgccgccgaccatgaactgcgtcccgccggcgaccgcagcagcaatggcgaagaagcaagcaagcccaaggccgtagttgcttga

SEQ ID NO: 121 - DNA, 688 bp, Zea Mays
cttttcttcagtatgaacattcaggagatatgtgtatccttgtcattcatgcaaattgtatccctgttgtctccttttcccttccccacgttttagtgtatctttttgtagcatgaaagccaagaccttttctttgtgctccaagaacatttgagcttattccacattcttgcaggagctctttctcttccgtcaaagggttccaccgatggcgataaagatgaaggggatcttcaaagggctgaagataatttctcaaatgtttgcgcataaggagcaggagatggagattgggtaccctacagatgtaaagcatgtggctcacattggtctgggcaccagtgacacatctccaagctggatggctgaattcaagggaacagatgattcatcagcaggctctgtgagcacagctgcgcagtcaaggcagacttcttgggcctctgcagacttcgagcagccgagaagcatgctgcccatcgacatcttccaggacaagaggcccgggcaagagaacccggacgtgcagaggggggagagaaaggcgaggaggaagaagacgaagaagaacagagcgtcgtcgccgcccgcttcgtccgcaaggtcgtcttccgcgaggtccacagcctcgtttgcgacggcgtacgacgccttcagcgagtcccagagagggttcccggtcgcctga

SEQ ID NO: 122 - DNA, 1890 bp, Zea Mays
ataccgcacgcacctgtccctgtcgcctccttacgtttcatcgcctcgcgaacccacccacccaaacagccaagtacagtgcgctgtctgcaataagcatccgcccttggatgcgcctcgccgcagccggccatggcctccgccgtcgctagcaacgtgcacgcgggacccgccgccgcggccatgtcgttcggctggctcggcccgggcctgccgttcggcgcccgggacgccgctgcggaggcggaggagcccgccgcggcggccaaggcggagccggcggcgatctgcaaggacttaatcgacttcgagttcagcctcggcgggtccgccaccatgctccccgcggacgagctcttcgcggacgggaagctgctcccgctccgcccgcaggctaccgcagggaaggcggaggccgagcgggagcgggagagagtgctgcggcgggacaccgcgcttgtggcggaggccacgccgggccctgtccgggcgctgcaccccgccgcggccgaggcggcgctggacccgtacgtgttctctcccaaggcgcccacgtgctccagccgctggcgggagctgctccggctgaggaaggtccagacgccgcacaagccgaccccgtccccgtcgccgtccgcgtccgcgtcgcccgcggtgaccccgtcgagggcgtccagctcctcggcggccaggtcgctgaagctgctcctcctccagcggaacggcggccgcgcgtcggacctccccgccgcgccgctcctgcgcgacagctccgactccgagacgtcgctgtccctcgcgtcctcccgcttctcgctctcgtcgtcgtcgtcctcgtccggccacgaccacgacgacttcccgcgccactccctcgactccgtcgacctcaccccacgcccccgcatccgcctcgtccgctcccaccaccaccagccgccgcagccgcagccgcagccacacccgcccgccgccgcctccgctccagtgcgcgcagcccacagccccgcccgccgccgccagtctcagtctccgtcgcccccgccgccgccgagcgtggtctccgtggactccccccgcatgaacgcgtcaggcaagatcgtgttccagggcctggagcgcagctccagctcccccgccggcagcgcgcactcgtccatgcggtcccggtcgcggtcccgcgtcatggaccggtcctactcggccggcgtccgcgccacgcccgtcgtgctcaacgtcccggtgtgctcgcgcccggtgttcgggttcttcaaggagaagaaagaggccgcggccagggacgccgcctcggcgcgggcgcggtcggcgctgggccggaagacggctgcgcgcaccgccccgccagccggcgtagcgagcgccagagatcttggcagtggtaactgacatccgtcattttggtggaccaagcggtctagtatcattagcactagaagtagacggcatttggagttcttcagtccgaaaaaaaagaaaatagatcgaaaaaacagtttgggaggtatcctgcgtttggagtttgggacacgattgggtgggaggatagtttggtgagctgattttcgcttcgtgaggccagagagtttttttgcgatcaacaaacccgtccgctttggtcctgtaaattctgtccgccgcgtggttttttttttgctccgtattaatccactgtactggcacatttgttgatctcatgctctcagtcgttcagatcccgactcccgagtgagaagaaaaggtgctgtaaaagctttgggtgcatgcttcgcctgttcttttatcatggcagattgatgctctgcgattacctgttcttccgtggcttgcgaactgaaaagcgaaataaagaggaagttgatggtgttaatc

SEQ ID NO: 123 - DNA, 471 bp, Zea Mays
gacgacagcggaggcgttcccatggcgacgtggcaggtcatcgtcgccgtggtcgaaggaacgcggctggcgccagacaccgctgacttggaggctattagcagctcagcagccacactccggttactgcagaccagcagcagcaccgcagccacgcagcagacggactccacggagaagacggcgctggccgtggccgcaacagccgccgtcgacctgaccaacctgttcttcctcctccgcggcgacaccgacaccgacgccgagcggcgacggcgctggggctggaccgggggaatctgcgtgctgttcgcgttcgcggctctcctttccgccgccggcaccgtgctcgctccgcacgtcgtgtccgcggcgcgccggcgggtcctcttggtggcttccgcggcggcgctgttcgtggcgtcggccggcacagtcctcgtcctgctgttggtggagctggacgcgtaa

SEQ ID NO: 124 - DNA, 466 bp, Zea Mays
gaagatcagaacaatcaatgtctagcatatagcacgtttcttctgacccaaatgagcgcgagacacaaacaaagcagatggatggtctggacgcgcagtaggtttcccgagctggacaaacacagctggtgtcgagccagcgtcggccgccatacggccctcgcctgcagcgggacggcagggcagcccgcagccggcggagctgcgcgagctcttcatttcactgcgcgcggtggcgccgggaggcgcaccgcgaccgcggtggacgcggcgatccaggcgcagaacgcggcgagggcgacgggccacggcacgctccctccggtgccgacgacgacgacgacgttgacgcaaagggaggcggcgacgagcagcgagagggagagcggcaggagccgcgggcccatagccgtggccaatactaccaaataccaatagagatttttggtctggggagagcgacgag

SEQ ID NO: 125 - DNA, 676 bp, Zea Mays
gagaagaacaggtggttcaggaggagcctcaaagcgagaagtatgatctgatctaggtggcgtttccccagttgacttttgcgccaaggatgattcttagttcgttttataatttatttttcatggacatcctcgctccaaggagtagaaagtaaacagggatgtacatgtcgaaggtagggaggaagactccaaggtgaactactcagacggaagcgtactcgacgataaggcaccggacgctcgcaagactcaaccccctcatggtctgatcaaacatgacaaaatggaggcacacatggtaacatatcagaaagcaccacacttccaagggtggaaatggtgtactccatcaaatctttatgtaattagtgaccactcgttcaattcctccgactatataaagggatgagggttgagctataggagtagggaaacttagttgataacattgttgtaaactatggtgacgtctaagagggggtgaattcggacttctaaaaatttcgctctaaattaggccacaaataaatccctagaacaaaacatattcaaatatgtaaactagattgtgcaaactaggtgttgactaaatgttgctatctctattgcaaaaggagtttcgcaacaagttacaatcattaatattctaactacaaatgagagattgaaactt

SEQ ID NO: 126 - DNA, 477 bp, Zea Mays
atgggagagggagccgtctcactgcgggtgtccgtgaggacaccgataggtgctaagggcaggaagaagaggggaaagaggaagtacctatgggagcagccacggtcgtcggcatcgaagtgggtcacaagagagggagccgctccgccgctggtgtttgcgaggatgagcgcgactacttgctgtcaaggcagcaccgcaactatgaagcaggatgtggatttggcgctcgcactcctcttttggctccgtcaaggatcggttcttctcaacgccagtaacttctccatcggtggcgtcctcgtgggacgtgtatttggccatggggatctgggcgccggggagagatggcggttgggccccccgcgagccccaccgcccagaacgttgtacgacaccactgcgcagggagatctagggagaggaagacagggggtggggaggggtgggcgtgggttagggttttgtcctgcgtaa

SEQ ID NO: 127 - DNA, 1709 bp, Zea Mays
ctctccctctccctcctttcttctcagcttgctggccatgagaccgctctcctcaacccaccatatttatctgcctcctctcgccacatgctctcctcctctgccggctcagtcgtgggacgagttccgatcccgacccctagcttccgctcccgatccgtcgtctcatcctctcctacttgctggcatgcgtcgtgcagatctggtcgagctcgtgttcgcgcttcgcggagatcgtcaggtgaccgagcgagccatggaggtagccggcgtcgtcgcgtccgcggccgacagccctggcgccgcggcggcgcggccgagccggtacgagtcgcagaagcggcgggactggcacacgttcgggcagtacctgcgcaaccaccggccgccgctggagctggcccggtgcagcggcgcgcacgtgctggagttcctgcgctacctggaccagttcggcaagaccaaggtgcacgcggcgcggtgccccttcttcggccacccgtccccgccggcgccctgcccgtgcccgctcaagcaggcgtggggcagcctggacgcgctcgtcggccgcctgcgcgccgcgttcgaggagcacgggggccggcccgaggccaaccccttcggcgcgcgcgccgtcaggctttacctccgcgaggtccgcgacagccaggccaaggcgcgcggcatcgcctacgagaagaagcgccgcaagcgccacccgccggcgcaccgccagcccaagcagcagcagcagcaggacggccagcaccagcacccgtcgcacgccgcgccgggcacggtggccgagccgccggcgccgcacttcttgatcccgcacgcgcacttcctccatggccatttcctggcgccggcgaccgagcccatcgacccggccgcgggcggaggtggcggcactggggatgatattgcgctggcaatggcagccgccgccgaggcgcacgcggccgggttcttgatgccgctgtccgtgttcaactagctagcttgcttgcttgcaccagtacttcttccaccgttccatcggcttaattagcagaaatgcaagagtgattaggcacgtaagtaaacttgcaggttctgctaatggcgaccgatttggtctcggcgtgcgcgcgcgatctaagtatgagatgacactggctgtgtgccccatcatcaaccgctgctactgcctgtctgcctgccagccttttggttgtactagtgattttgcatggtcttgtgtatgcagtgatccatagaatggcaggattagatggcttgttcattctccctggcgacgttcttcttggggatttcatgtggtgtaaggctatctccagaaaaccgtatatatatgaacatgcaaagtaatgctttgcattgaaatagagagtaagatatggcgcaagtagagcacaagcacaacacacaaacgatttatctaatggttcagtttgtgactaaggcttgtaccaccacattgttgagaaagccaccaaggctagagttgtgggagattacaaacggcttaaagtaactacaagagcatggtgcttcaatgagatacaactagttggctagcagctcttgctccaagagtaatagatagaaaccactagcctgagcacaatccaagtgctccacgaggagttatatctcaggatgaacaactctctaatgaagatttgcatgccaagatttctcgg

SEQ ID NO: 128 - DNA, 1692 bp, Zea Mays
ctccctctccctcctttcttctcagcttgctggccatgagaccgctctcctcaacccaccatatttatctgcctcctctcgccacatgctctcctcctctgccggctcagtcgtgggacgagttccgatcccgacccctagcttccgctcccgatccgtcgtctcatcctctcctacttgctgatctggtcgagctcgtgttcgcgcttcgcggagatcgtcaggtgaccgagcgagccatggaggtagccggcgtcgtcgcgtccgcggccgacagccctggcgccgcggcggcgcggccgagccggtacgagtcgcagaagcggcgggactggcacacgttcgggcagtacctgcgcaaccaccggccgccgctggagctggcccggtgcagcggcgcgcacgtgctggagttcctgcgctacctggaccagttcggcaagaccaaggtgcacgcggcgcggtgccccttcttcggccacccgtccccgccggcgccctgcccgtgcccgctcaagcaggcgtggggcagcctggacgcgctcgtcggccgcctgcgcgccgcgttcgaggagcacgggggccggcccgaggccaaccccttcggcgcgcgcgccgtcaggctttacctccgcgaggtccgcgacagccaggccaaggcgcgcggcatcgcctacgagaagaagcgccgcaagcgccacccgccggcgcaccgccagcccaagcagcagcagcagcaggacggccagcaccagcacccgtcgcacgccgcgccgggcacggtggccgagccgccggcgccgcacttcttgatcccgcacgcgcacttcctccatggccatttcctggcgccggcgaccgagcccatcgacccggccgcgggcggaggtggcggcactggggatgatattgcgctggcaatggcagccgccgccgaggcgcacgcggccgggttcttgatgccgctgtccgtgttcaactagctagcttgcttgcttgcaccagtacttcttccaccgttccatcggcttaattagcagaaatgcaagagtgattaggcacgtaagtaaacttgcaggttctgctaatggcgaccgatttggtctcggcgtgcgcgcgcgatctaagtatgagatgacactggctgtgtgccccatcatcaaccgctgctactgcctgtctgcctgccagccttttggttgtactagtgattttgcatggtcttgtgtatgcagtgatccatagaatggcaggattagatggcttgttcattctccctggcgacgttcttcttggggatttcatgtggtgtaaggctatctccagaaaaccgtatatatatgaacatgcaaagtaatgctttgcattgaaatagagagtaagatatggcgcaagtagagcacaagcacaacacacaaacgatttatctaatggttcagtttgtgactaaggcttgtaccaccacattgttgagaaagccaccaaggctagagttgtgggagattacaaacggcttaaagtaactacaagagcatggtgcttcaatgagatacaactagttggctagcagctcttgctccaagagtaatagatagaaaccactagcctgagcacaatccaagtgctccacgaggagttatatctcaggatgaacaactctctaatgaagatttgcatgccaagatttctcgg

SEQ ID NO: 129 - DNA, 1597 bp, Zea Mays
cttctgtagctcggctcactagtgattgagtcgattaaagtttgcagttttgctttgcttccttccgttctccgcattttccttgtgcgttttttctttaacttcaatgtgcgtcagttcgttcttgcatgtctgctgtctgctacggatcagctctagatcatcaaactgtgctagtcaattccagatagagagagtaggagtaggtatatcgctacagagtgcaggcatacaggttggtgtggcagctagctgagtctagcctgaaaccctagctagttcatcgaggattctgaattcctggtccgtcccagctccgtcgccccggccggccaagaatagatgaagcgactgatccgaccagctctttgctccttgcattattcgtcctttttattatacgtatagtataaccatagccaaatcgtttcactatccaaccaggcatgcgtcgtgcagatctggtcgagctcgtgttcgcgcttcgcggagatcgtcaggtgaccgagcgagccatggaggtagccggcgtcgtcgcgtccgcggccgacagccctggcgccgcggcggcgcggccgagccggtacgagtcgcagaagcggcgggactggcacacgttcgggcagtacctgcgcaaccaccggccgccgctggagctggcccggtgcagcggcgcgcacgtgctggagttcctgcgctacctggaccagttcggcaagaccaaggtgcacgcggcgcggtgccccttcttcggccacccgtccccgccggcgccctgcccgtgcccgctcaagcaggcgtggggcagcctggacgcgctcgtcggccgcctgcgcgccgcgttcgaggagcacgggggccggcccgaggccaaccccttcggcgcgcgcgccgtcaggctttacctccgcgaggtccgcgacagccaggccaaggcgcgcggcatcgcctacgagaagaagcgccgcaagcgccacccgccggcgcaccgccagcccaagcagcagcagcagcaggacggccagcaccagcacccgtcgcacgccgcgccgggcacggtggccgagccgccggcgccgcacttcttgatcccgcacgcgcacttcctccatggccatttcctggcgccggcgaccgagcccatcgacccggccgcgggcggaggtggcggcactggggatgatattgcgctggcaatggcagccgccgccgaggcgcacgcggccgggttcttgatgccgctgtccgtgttcaactagctagcttgcttgcttgcaccagtacttcttccaccgttccatcggcttaattagcagaaatgcaagagtgattaggcacgtaagtaaacttgcaggttctgctaatggcgaccgatttggtctcggcgtgcgcgcgcgatctaagtatgagatgacactggctgtgtgccccatcatcaaccgctgctactgcctgtctgcctgccagccttttggttgtactagtgattttgcatggtcttgtgtatgcagtgatccatagaatggcaggattagatggcttgttcattctccctggcgacgttcttcttggggatttcatgtggtgtaaggctatc

SEQ ID NO: 130 - DNA, 1710 bp, Zea Mays
aaagcacacgcacaccaaactaccaaaccaacagagcaacatcaatgcgccttccgccgccatcaaccaccgcggccgcagccgctgccaccgtcggggccgtactcgccgcagtcgccctccgccgctacctgtccgcttctcgccaccgcgaacccgcccgcgtgcccatgtccgcggccgccggagccaccacgcttgtggtgtacggcaaatcggcgcaggagcaggagctgctggcctccgcggccggttccgtcgtcctcggtgagggcgatccgtccggtgatgtcgccatcgcgctcgcctacgagagcgcgggcttcgacgccgccgcgtacatgagcgcgctccgggcgcgccggttcgggaggtggatgctctggacgcccaggattggttccacgcaggatctcatcacgcggaactttgcaaagctaccggtgggcgttgtgtgcgttgccgacgtgcagttcaaagggagaggccgttcaaagaatgtgtgggaatcgccaccaggctgtctcatgttctctttcacatcacagatgcaggatgcacggaagttgccccttatgcaatatgttgtctgcctttcgataactgaagctatcaaggagctgtgccgtgccaagggactaccagaacttgatgtgagaataaaatggcctaatgatctctatctgaaaggattaaaagttggtggcattctatgtacctcatcttatgaacccaaagtgtacaatatttgtactggtgttggtttgaatgttgacaatgagaagcctaccacatgcttgaatgctgcacttcaagaggcaaatcatacatcacccatattgaaacgagaagacatattggcatacttcttcaataaatttgaaaaccttttcgagatcttcatgaaccatggatttcaggttcttgaggagcaatactataactcatggcttcatagtggccagagagttgtcgtacatgatgcacatgaaaacaagtcaggcagtgtcgtcaccatccaggggttaacaccaactgggtacttacatgctattggtgaggataacaaaagctatgagttgcacccagatggcaacagctttgatttcttcactggattggtgaggaggaagatggaagcttagggtatcaatacaatgggatacatggatagattcaacagactgtacaaatgaatggaatgagaacatgatttaagcatcagccccctccatctgtattcaaaccttgtgcttggaataaatagaaggaatgctcttatcacaatcctgaacggccgctttgagacctcaaaccttaacaagtgccccaccctcgcaattccatttgcgacagctcagcataaacaattaagaagacaatcaaccgtgactgaagcccaggcatgagttcagatctcaggtgaagaaatcgcagtgactgaagaccgtttacttgaatgattcatatttcataggaagaatgcatgaaaattatgaagcacatctgctccattgatgggcggacagcttcttcggcagtgtttggggctcatgtttgcatcaggttctgtataactgcagtgttttttctattagtgaactaagttggaaatctgctgcaactgcaagatttgtagcggtgatgtatgagttggtaacttgtatttgcacagatgcttaactgaaaggacatgttatatattatcca

SEQ ID NO: 131 - DNA, 2831 bp, Zea Mays
atggccaacctagcggcccagctcgctgccgtgctccaggcctgcatcaagcgtagcggtggccgcaagcccagccgctcaaacgccaaggccgcgcacgcgcgcgtcctcgccgccggcctcgccgcagataccttcctcctcaaccgcctcgtcgagctctactccctctcgggcctgccatgccacgcgctccgcgccttccgcgcgctgccccaccccaacgtctactcctacaacgccgccatctcagctgcctgccgcgcgggggacctcgccgccgcccgggacctgctcggccgaatgcccgaccggaacgccgtctcctggaataccgtcatcgccgccgtcgcgcggtcgggctccccgggggaggcgctagagatgtaccaggggatgctgcaggagggcctcgcgccgacgaacttcacgctggccagcgtgctcagcgcgtgcggcgccgtggccgcgctcgacgacgggaggcgctgccatgggctcgccgtcaaggtcgggctcgacgggcaccagttcgtcgagaacgggctcctcggcatgtacacaaagtgcgggagcgtcgccgacgcggtcaggctgttcgacgggatgcctagcccgaacgaggtgtcgttcacggcgatgatgggcgggttggcgcagggcggggccgtcgacgatgccctcaggttgttcgcgcggatgagcaggaccgggattcgtgttgatccggtagcggtctccagtgttctcggcgcctgcgcgcaggcctgcgctggtgactacaatgtcgctcgtgcaatccagctcgcacagtccatccatgcattggttgtcagaaaaggttttggatcggaccaacacgtgggtaactcgttggttgatctgtacgcgaagggcatgaagatggatgaggccatcaaagtctttgagtcgttgtccagtgttagtattgtttcttggaacattcttataactgggtatggtcagctgggatgctatgagagggccatggaagttcttgagtttatgcaagagtcaggctttgagcccaatgaggtaacctacagtaacatgcttgcttcttgtattaaggcaagggatgttccgtctgctcgtgcaatgtttgacaagataccaaagccaagtgtgactacatggaacaccctattatctggctacggccaggaggaactgcatcaagaaacaatcgacttgtttaggagaatgcaacatcaaaatgtgcagcctgaccggacaactttagctgtgatactcagttcatgttctagattaggaaatttcgaactgggcaagcaagtgcattctgcttcagtaagactactgcttcataatgacatgtttgttgcgagtggtctgatagatatatattcaaagtgtggtcaggttggcatcgcactgatcattttcaacatgatgaccgagagagatgtggtatgctggaattccatgatctcaggtttggctatccattctttgagtgaagaggccttcgatttcttgaagcagatgagggaaaatgggatgttccccacagaatcctcttatgctagtatgatcaatttgtgtgctagattgtcatccatacctcaaggtaggcagatgcatgcacaggttctgaaggatggttatgatcagaatgtatacgttggctgttccctgatcgacatgtatgctaaatctggcaacatggatgatgcacgccttttctttaactgcatgattgtgaagaacttagtggcatggaatgagatgatccatggatatgcccagaatggttttggagagaaagctgtggaattgtttgagtacatgctaaccacaaaacagaagcctgacagtgtgactttcattgctgtactgacaggatgcagtcactctgggctcgttgatgaagcagttacattctttaattccatggagagcaattatgggattacaccattagttgagcattacacttgcctgatagatgcactggcgcgggctgctcgttttgctgaagttgaggcagtgataggtaaaatgccatacaaggatgatcctatactgtgggaagttctactagctgcatgtgttgtacatcacaatgctgagttgggggaattttctgccaagcatctattccgccttgatccaaaaaatccatcaccttatgtgcttctatcaaacatatatgctactttgggtagacatggtgatgcctcagctgttagggcgctgatgagtagtcgcggtgttgtgaaaggccgcggatacagctgggtgaatcacaaggatggttctcgtgcctttatggtagctgatgatcttggaacggatgttggagaacgcacaatgttcagtgataatggggacacttctgggatgacagaagtgcacatagatgaaacctgtgctggatgatttgaaatctggtgctgctgctagcctgctaccatcttcactgaaaccttaaaccaatattagttgaatccagcaggctcaatctggtgttgggagcctcaggtttcactgttgttttagcttcaagcgttactgcaaattaggcatggtctgaacgtttgggaggaaagtgtgaactgaaggaaatgtacattgcagattggtgcaaagacaacttcaagctggattgattagtttatttcatcatattctgcaaaaggtgtgttgagccatgacatgtggaagctcataccaattcctagcttcatgcaccatgatgagtgtaaatttcttcccagatgagtcaaggataaaattgcaattgttttttgaagtgtataatgggagaaaaaggtaacactaactgt

SEQ ID NO: 132 - DNA, 1486 bp, Zea Mays
tcgggccagagaggaattaattgttaaacaccttctcgttatccatcgctgtgccgggtgcctccgtcagcacgggacgactcggtttcggatgcagtgcatgcatgcaaactacgcgcgcgcagctttgattatttcgcgcgtcgaagcacagcaggccgagcaggccgtgtccaagatgattaacacacgtaacgtacgcacgcagtcaaactagctaacacgcgcgctgtgcagcaccatgctgcaccaaccggctatatatacgtatgtccatgtacaccaagcctcaagaagctcgcatcgcaagccgatcttttactcctccttctctaattcaagccaagacatagcttgtaggctaaagcaatggcaagcgtcgtcgtcaggcccagcaagctcctccttgctctccttgtcgcggcaatggcagcgtctcctcgggctctcgcgtacgacccgagccctctgcaggacttctgcgtcgccgacaccgcctccaacgtgttcgtgaacgggcaggcgtgcaaggacccggcgcaggtgacggcggccgacttcgccttctcgggcctgcaggacgcgggcgacaccgggaacgcgttcggctccaaggtgacgctggtggacgcgcgggcgctgcctgggctcaactcgctgggcgtcgccatggcgcgcctcgacatcgcgccgggcggcgtcaacccgccgcacacgcacccgcgcgccaccgaggtgctcaccgtcgtggagggccagatgtacgccggcttcctcgccaccgacggcaagctcttcgccagggtgctcaaccggggcgacgccttcgtcttccccaggggcctcgtccacttcgagttcaactgcggcgccggccccgccgtcggcctcgccggcctcagcagccagaaccccggcctcgtccgcgtcgccgactcgctcttcggcgccgcccccgccgtcaccgacgaggtcctcgccaaggcgttcaggatcgacgccgccaccgtgcagaggatcaaggcgcagtttgccaaaaagtagattgttgttcactgctagtaaaatggcccgtcggtgtcctttattgttgtttgtgtatagattccctggctgaatattgcccgggtatcggtcctttatttgtcatcaaattctgatttggttactttttttttcttgtctgtattaattcatcatgtccttattggataaatatttctgttttttaagtagtcgaacaatgcaattataatctatcttgcacatcttattaaaacaattaatctatattccctttatccatttctttaacggcatcagcgctgctgttttgattatgtgtttagccgatcaaggtttgtttagttcattactatttactacggccctgtatagaacggcaacaaatggctccgactccctggcacagacgcacagtcgtagacgaagtggaacaaataataaaacaaaaagaatactccca

SEQ ID NO: 133 - DNA, 330 bp, Zea Mays
atgtgggcaaattgctacctccaatcaacaatggacccaggccggcagatggcttcgatcagagcatgtagcgccacaccgctagctcatcatacaatagacccacccgatccattggagcactgggtcgaagcaggattacatgtatggacagaccggtgcttctagagtactcatttggttctatggatcacatccggtttgctccatagagcaactaaccccatatttagccacgatccattacgggtcctaaatgtatccgatctatgttctggagctcaggcacaattgcaggaccggcataagcatgaatcaacagcgcacaag

SEQ ID NO: 134 - DNA, 1335 bp, Zea Mays
atgagggagatcctgcacatccagggcgggcagtgcgggaaccagatcggtgccaagttctgggaggtgatctgcgacgagcacggcatcgaccacacgggcaagtacgccggcgactccgacctccagctcgagcgcatcaacgtctactacaatgaggccggcgggggccggttcgtcccgcgcgccgtgctcatggacctcgagcccggcaccatggactccgtgcgctccggcccctacggccagatcttccgccccgacaacttcgtcttcggccagtccggcgccggcaacaactgggccaagggccactacaccgagggcgccgagctcatcgactccgtgcttgacgtcgtccgcaaggaggccgagaactgcgactgcctccaaggatttcaggtttgccattcattgggtggaggtactggctcagggatgggcaccctgctcatctccaaaatcagggaagagtacccagataggatgatgctgacgttctcagtttttccatcacccaaggtgtctgatactgtggtagaaccttacaatgccacgctctcagttcatcaacttgttgagaatgctgatgagtgtatggtcctcgacaacgaagctctctacgacatctgcttccgcactctgaagcttgctacacccactttcggtgacctgaaccatctcatctctgcaaccatgagtggtgttacctgctgcctgcggttcccaggccagctgaactcggacctccggaagcttgcggtcaacctgatccccttcccccgcctccatttcttcatggtcggcttcgcgccgctgacgtcaagggggtcccagcagtaccgcgccctgaccgtcccggagctgacccagcagatgtgggacgcgaagaacatgatgtgcgcggctgacccgcggcacgggcgctacctgacggcgtcggccatgttccgcgggaagatgagcaccaaggaggtggacgagcagatgctgaacgtgcagaacaagaactcgtcctacttcgtggagtggatcccgaacaacgtgaagtcgagcgtgtgcgacatcccccccacgggcctggcgatggcgtccacgttcgtcggcaactccacctcgatccaggagatgttccggcgcgtcagcgagcagttcacggccatgttccggcgcaaggccttcctgcactggtacaccggggagggcatggacgagatggagttcaccgaggccgagagcaacatgaacgacctggtggccgagtaccagcagtaccaggacgcgacggcggaagaggaggaggagtacaaggagggagatgaggtggctgcctga

SEQ ID NO: 135 - DNA, 1251 bp, Zea Mays
atggagttcacgcttatcccaaatttagtaccacaaaatagacatgctgttataaaaggtaatggtataagtgctgaaatcccaggaaatctagctgaagagaaaggatctatcatcgaagaaaatgaaatatatgagatcagtagattcacaatatcttcagcaagacaaatgttcaaacctgttcatatagacaaaatgatccacttcacatatcacacaattattaaggcatcacttgattctccgtcaacatttcctagatatgtctatcatctgactccattgcatcaaatcgaatcctatattcaaaagaatgaatacttccttgatgtgctcggagttatcactcaagtgagtgcattaaaaccagttcggacacagacccgggaaagctcaaatgtcataaaagagatcatcataaaagatatcaatgatgtcacaatgagactaaccctatgggcagaacgagctaaagcttttaaattagatgatgtttacaatcctctagagcaaaagccaatcgtcacactctttgtaggttgtttagccaaaaatttccaaggtgcatacttaaatggtggaacaacatgtagatggtatttcaatcctgatattaaggaagccgctccttattatcaaaggtttggatctcaaaaagtaaaactacaaataccatcagagcaggaacaacaactatctgttgcaaaagaaacacatgtagaacacaaaaccttgcatgagcttcttgcgttggatccatatgcatttccgaaacaaggatatgaatgcacagttacaatcatagaagtacctacaacaaatcgttggtggtttccagcttgcaccaaatgcagtcgagcatgtagaccacaagatggtggttactattgctcctactgtaaatcagaagcgtacacactaaggtctcaagtcttggatgtagcacaaggaactaatgcagataagggaatccccactgataaaggcaaagagatcgaacctcatcttcaatctcctccaaaaaggtctcaagtcttggatgtagcacaaggaactaatgcagataagggaatccccactgataaaggcaaagagatcgaacctcatcttcaatctcctccaaaaagccccgactccaagaagttggcggtcgcatccggcgtatcgaggtcggtgctcttcctgctcgtcgacgtcgctgtcaaagctgttgagtccgagatcacttgttttctgtattccaaatga

SEQ ID NO: 136 - DNA, 672 bp, Zea Mays
atggccctcgatccagccgccgcgtcggccgtttggggggagggggtggggagcggcgcggcatgcctcggcgcgtgcgcgatctgcgaggcacggcccacgtgggcgctcggcgcgggccccacgagggcgctcaggcggcctcctccagaggcgagcgcgagggagcaagccccggcgagggcgcttagcgcggctcccgagggcgctcggcgcggctcccgtggcgcgctcagcgcgggcaccagagggcgcggcgtggccccacgcgtggccggcggctgcgcgctggaggctctgcgcccggcggctggcggtgctcgggcgggccccacgagggcgcgctgcacacaaggtgcgcgcggctccgcggttcggcgaggcatgcaggcctggcggcctcaagccaggcgcgacccggccatgggcgaggctccggccaggcgcccagcctggcatacctggcacaggagcagaacggccaagccagtcgcagactggagcaggcgagtccccgcgcagacgcgcgcgcataggccccggccaatcgcggctcccaggccgggtctcgcgctggacgcgggaagcatccttggcgcgttggctcccttgtggagcctcaagcgcgcaggaccggccccctggtggagccccggcggcggctgcttctga

SEQ ID NO: 137 - DNA, 1018 bp, Zea Mays
cgtgtcacggtcgccgccacagccccagttccaggcgcggccgtacgggcccggaccacggacgcagcacggcaccgcgcggacctcccagtcccactcccttcccgcaccgcagacgcagagcagccaaacgccacctcgagcccccgagcgcctgcgcagaccgcagccaggaaaccgccttctccgacatccggctctcctccacgctcccgctactccgctccagctccaccgccaccaccaccaccgacccacccatcccatccagccatgaagcggctcctgcggcggctgtcccgcacggtggtggcggcggcggcgtccagcgaggacggcggtgcggcggcgcggcccagcagcaaggacgacgggagcaggaggcgcaggaggaagaaggcggggtccgtgccggagggccacgtgcccgtgtgcgtgggcgaggagggcggccccgtggagcgcttcgccgtgcgcgccgagctgctgggcgagccgcccttcgccgcgctcctccgccgcgccgcgcaggagtacggctacgcgcaccccggcgcgctccgcatcccctgccccgtcgccgacttccgccgcctcctgctccgcctctcccgcgaccccgcgcccgccgccggacgctacgcctacgcctaggcgccgtccgtccctacttcgtgctctccgccgccgctggagaccgtctgcgcttccgcggttttagccctactactagggggcggcaggatggggctctcctttttatttttcctctttttttacggcttgctagtgtagtagccgtactagcagtagctgctcgatggaagaactacagccgggtgtcttatttttttacccccttctggttctaggactctcctcgcagtgtggtgcgcgtctgtgcttagaaaaaagttggctggagaattcggcattaaccgatgctcctccatttccatccaggccattcatattagtgttgcctgttgatgaggtaatcagtaatttcctctttttt

SEQ ID NO: 138 - DNA, 1748 bp, Zea Mays
accaacaagtgcagtcacccgagccgcaaactgcagctctgcaagctacagaggccaccacgagtccacgacgccacgccctccgagagaaagagaaagagaaaaccaaagcacgataatgcccccgacccccacagccgccgcagccggcgccgccgtggcggcggcatcagcagcggagcaggcggcgttccgcctcgtgggccaccgcaacttcgtccgcttcaacccgcgctccgaccgcttccacacgctcgcgttccaccacgtggagctctggtgcgccgacgcggcctccgccgcgggccgcttctccttcggcctgggcgcgccgctcgccgcacgctccgacctctccacgggcaactccgcgcacgcgtccctgctgctccgctccggctccctctccttcctcttcacggcgccctacgcgcacggcgccgacgctgccaccgccgcgctgccctccttctccgccgccgccgcgcggcgcttcgcagccgaccacggcctcgcggtgcgcgccgtcgcgctccgcgtcgccgacgccgaggacgccttccgcgccagcgtcgcggccggggcgcgcccggcgttcggccccgtcgacctcggccgcggcttccgcctcgccgaggtcgagctctacggcgacgtcgtgctccggtacgtgagctacccggacggcgccgcgggcgagcccttcctgccggggttcgagggcgtggccagccccggggcggccgactacgggctgagcaggttcgaccacatcgtcggcaacgtgccggagctggcgcccgccgccgcctacttcgccggcttcacggggttccacgagttcgccgagttcacgacggaggacgtgggcaccgcggagagcggcctcaactccatggtgctcgccaacaactcggagaacgtgctgctcccgctcaacgagccggtgcacggcaccaagcgccgcagccagatacaaacgttcctggaccaccacggcggccccggcgtgcagcacatggcgctggccagcgacgacgtgctcaggacgctgagggagatgcaggcgcgctcggccatgggcggcttcgagttcatggcgcctcccacatccgactactatgacggcgtgaggcggcgcgccggggacgtgctcacggaagcacagattaaggagtgccaggagctaggggtgctggtggacagggatgaccagggcgtgctgctccaaatcttcaccaagccagtgggggacaggccaacgctgttcttggaaatcatccaaaggatcgggtgcatggagaaggatgagaaggggcaagaataccaaaagggtggctgcggcgggttcggcaagggaaacttctcgcagctgttcaagtccatcgaggattatgagaagtcccttgaagccaagcaagctgctgcagcagctgcagctcagggatcctaggacagtgcttggagacgagcaactgctgtggcactttgtatcatggaacagaaataatgaagcgtgttctttgtgacacttgacatgcaaatgtttgtgttctgtaaccgttgaatatatgggacgatgctatgatggtgtaatagatggtagagagggtacaaccctgatactaatgatgcactattgcatctctgttgtacaagtttgcatgaaaataacgacgagggtcagtatgaggcataatgaatctgttcctgggattcttgtactcacctggtgctttttttttatg

SEQ ID NO: 139 - DNA, 1948 bp, Zea Mays
tgatccgctggcgctcgcggtgaggcgtcgaaggtcaacccctatcttccacctcggggggactgcctacccggtggatcgacgcagcagctttattggttccccggagacctgcaagttgcaagacgagctagacctagcaaccgctccctgccgaccttcggcgtcttggagtaaacatttcggcgtccagtaccgaagatctcccatccgctctgtcgatttgcaatggagcccggcagcccagccccgaagaaatcacggctggtgcactcagcggactgcgaaatggaggaggcgcaggcgccttccagttccaatgcagcggggggcgtgaaccagagcttgcactggacccagtggcagatcctggactccatcctcccgaccggcggcttcgcgcactcgtacggcctcgaggccgccatgcagtcccgcgtggtgaacgaccaggaggacctgaggtcgttcgtcgtccaggtcctcgacagcgccggcagcctgctgctgccgttcgtgcactgcgcatgcgcaggcaagtcccccggcgacgcagcggcgtgggccaagctggaccggttgctggacgccacgttgacgaacgaggtcgccaggaaggcgtccgcggctcagggctcggctctgctgcgggtggccgcgtccgtcttcgccgaggttccggcgctgcaggagctccggcggacgttgctgggctccaagagcgtgtcgttccaccacgcgcctgtgtttgggctggtgtgcggcttggttggattcgacggcgagacggcgcagcgggcgtacatgttcgtgacgatgagggacgtgctctctgccgcgacgaggctcaatctgatcggcccgctggctgcttcggtgctgcagcaccagcttgcgccggatgccgagaggatggtgcggaaatggagggaccgtgatgtctctgaggcgtcacagactgccccgctgctcgatgccgtgcagggctgccacgcttacatgttctccaggctgttttgttcgtgacaacaaggttactgagatcaatgcgcaatctgttgtattcttgccgcaggatcacatcgacaggagccaacgacagctgtcttctcataaaaaaaaagcaccaggtgagtacaagaatcccaggaacagattcattatgcctcatactgaccctcgtcgttattttcatgcaaacttgtacaacagagatgcaatagtgcatcattagtatcagggttgtaccctctctaccatctattacaccatcatagcatcgtcccatatattcaacggttacagaacacaaacatttgcatgtcaagtgtcacaaagaacacgcttcattatttctgttccatgatacaaagtgccacagcagttgctcgtctccaagcactgtcctaggatccctgagctgcagctgctgcagcagcttgcttggcttcaagggacttctcataatcctcgatggacttgaacagctgcgagaagtttcccttgccgaacccgccgcagccacccttttggtattcttgccccttctcatccttctccatgcacccgatcctttggatgatttccaagaacagcgttggcctgaatgacgcagctggtccagttagattttggattgcataggggtcaaggaaaccatggcattgacactagaatgctgagctatgatcttcagaattaaagtgcaggggattaatgatgagaatggaatgttgaccatcatgtaatcagctgggacatgggagctcgaattatgattcacagcatgcaaaaaggatcctcttttttgctgtcacggtcttcataaagatgcatcatgcatggaggcacaaaaagagggtttgataccttcgtactgtatatatattctatatatgcctgcaatcctgaactagctgaataccttatcctggaattgttcctttgc

SEQ ID NO: 140 - DNA, 1958 bp, Zea Mays
gcagcgtgatccgctggcgctcgcggtgaggcgtcgaaggtcaacccctatcttccacctcggggggactgcctacccggtggatcgacgcagcagctttattggttccccggagacctgcaagttgcaagacgagctagacctagcaaccgctccctgccgaccttcggcgtcttggagtaaacatttcggcgtccaggcaataccgaagatctcccatccgctctgtcgatttgcaatggagcccggcagcccagccccgaagaaatcacggctggtgcactcagcggactgcgaaatggaggaggcgcaggcgccttccagttccaatgcagcggggggcgtgaaccagagcttgcactggacccagtggcagatcctggactccatcctcccgaccggcggcttcgcgcactcgtacggcctcgaggccgccatgcagtcccgcgtggtgaacgaccaggaggacctgaggtcgttcgtcgtccaggtcctcgacagcgccggcagcctgctgctgccgttcgtgcactgcgcatgcgcaggcaagtcccccggcgacgcagcggcgtgggccaagctggaccggttgctggacgccacgttgacgaacgaggtcgccaggaaggcgtccgcggctcagggctcggctctgctgcgggtggccgcgtccgtcttcgccgaggttccggcgctgcaggagctccggcggacgttgctgggctccaagagcgtgtcgttccaccacgcgcctgtgtttgggctggtgtgcggcttggttggattcgacggcgagacggcgcagcgggcgtacatgttcgtgacgatgagggacgtgctctctgccgcgacgaggctcaatctgatcggcccgctggctgcttcggtgctgcagcaccagcttgcgccggatgccgagaggatggtgcggaaatggagggaccgtgatgtctctgaggcgtcacagactgccccgctgctcgatgccgtgcagggctgccacgcttacatgttctccaggctgttttgttcgtgacaacaaggttactgagatcaatgcgcaatctgttgtattcttgccgcaggatcacatcgacaggagccaacgacagctgtcttctcataaaaaaaaagcaccaggtgagtacaagaatcccaggaacagattcattatgcctcatactgaccctcgtcgttattttcatgcaaacttgtacaacagagatgcaatagtgcatcattagtatcagggttgtaccctctctaccatctattacaccatcatagcatcgtcccatatattcaacggttacagaacacaaacatttgcatgtcaagtgtcacaaagaacacgcttcattatttctgttccatgatacaaagtgccacagcagttgctcgtctccaagcactgtcctaggatccctgagctgcagctgctgcagcagcttgcttggcttcaagggacttctcataatcctcgatggacttgaacagctgcgagaagtttcccttgccgaacccgccgcagccacccttttggtattcttgccccttctcatccttctccatgcacccgatcctttggatgatttccaagaacagcgttggcctgaatgacgcagctggtccagttagattttggattgcataggggtcaaggaaaccatggcattgacactagaatgctgagctatgatcttcagaattaaagtgcaggggattaatgatgagaatggaatgttgaccatcatgtaatcagctgggacatgggagctcgaattatgattcacagcatgcaaaaaggatcctcttttttgctgtcacggtcttcataaagatgcatcatgcatggaggcacaaaaagagggtttgataccttcgtactgtatatatattctatatatgcctgcaatcctgaactagctgaataccttatcctggaattgttcctttgc

SEQ ID NO: 141 - DNA, 2032 bp, Zea Mays
gcagcgtgatccgctggcgctcgcggtgaggcgtcgaaggtcaacccctatcttccacctcggggggactgcctacccggtggatcgacgcagcagctttattggttccccggagacctgcaagttgcaagacgagctagacctagcaaccgctccctgccgaccttcggcgtcttggagtaaacatttcggcgtccaggcaataccgaagatctcccatccgctctgtcgatttgcaatggagcccggcagcccagccccgaagaaatcacggctggtgcactcagcggactgcgaaatggaggaggcgcaggcgccttccagttccaatgcagcggggggcgtgaaccagagcttgcactggacccagtggcagatcctggactccatcctcccgaccggcggcttcgcgcactcgtacggcctcgaggccgccatgcagtcccgcgtggtgaacgaccaggaggacctgaggtcgttcgtcgtccaggtcctcgacagcgccggcagcctgctgctgccgttcgtgcactgcgcatgcgcaggcaagtcccccggcgacgcagcggcgtgggccaagctggaccggttgctggacgccacgttgacgaacgaggtcgccaggaaggcgtccgcggctcagggctcggctctgctgcgggtggccgcgtccgtcttcgccgaggttccggcgctgcaggagctccggcggacgttgctgggctccaagagcgtgtcgttccaccacgcgcctgtgtttgggctggtgtgcggcttggttggattcgacggcgagacggcgcagcgggcgtacatgttcgtgacgatgagggacgtgctctctgccgcgacgaggctcaatctgatcggcccgctggctgcttcggtgctgcagcaccagcttgcgccggatgccgagaggatggtgcggaaatggagggaccgtgatgtctctgaggcgtcacagactgccccgctgctcgatgccgtgcagggctgccacgcttacatgttctccaggctgttttgttcgtgacaacaagccatacacgatacatatccctggacaaaactagcagccttccatggccatggctgatggctccaagtgatttctgttactgagatcaatgcgcaatctgttgtattcttgccgcaggatcacatcgacaggagccaacgacagctgtcttctcataaaaaaaaagcaccaggtgagtacaagaatcccaggaacagattcattatgcctcatactgaccctcgtcgttattttcatgcaaacttgtacaacagagatgcaatagtgcatcattagtatcagggttgtaccctctctaccatctattacaccatcatagcatcgtcccatatattcaacggttacagaacacaaacatttgcatgtcaagtgtcacaaagaacacgcttcattatttctgttccatgatacaaagtgccacagcagttgctcgtctccaagcactgtcctaggatccctgagctgcagctgctgcagcagcttgcttggcttcaagggacttctcataatcctcgatggacttgaacagctgcgagaagtttcccttgccgaacccgccgcagccacccttttggtattcttgccccttctcatccttctccatgcacccgatcctttggatgatttccaagaacagcgttggcctgaatgacgcagctggtccagttagattttggattgcataggggtcaaggaaaccatggcattgacactagaatgctgagctatgatcttcagaattaaagtgcaggggattaatgatgagaatggaatgttgaccatcatgtaatcagctgggacatgggagctcgaattatgattcacagcatgcaaaaaggatcctcttttttgctgtcacggtcttcataaagatgcatcatgcatggaggcacaaaaagagggtttgataccttcgtactgtatatatattctatatatgcctgcaatcctgaactagctgaataccttatcctggaattgttcctttgc

SEQ ID NO: 142 - DNA, 1309 bp, Zea Mays
tgatccgctggcgctcgcggtgaggcgtcgaaggtcaacccctatcttccacctcggggggactgcctacccggtggatcgacgcagcagctttattggttccccggagacctgcaagttgcaagacgagctagacctagcaaccgctccctgccgaccttcggcgtcttggagtaaacatttcggcgtccagtaccgaagatctcccatccgctctgtcgatttgcaatggagcccggcagcccagccccgaagaaatcacggctggtgcactcagcggactgcgaaatggaggaggcgcaggcgccttccagttccaatgcagcggggggcgtgaaccagagcttgcactggacccagtggcagatcctggactccatcctcccgaccggcggcttcgcgcactcgtacggcctcgaggccgccatgcagtcccgcgtggtgaacgaccaggaggacctgaggtcgttcgtcgtccaggtcctcgacagcgccggcagcctgctgctgccgttcgtgcactgcgcatgcgcaggcaagtcccccggcgacgcagcggcgtgggccaagctggaccggttgctggacgccacgttgacgaacgaggtcgccaggaaggcgtccgcggctcagggctcggctctgctgcgggtggccgcgtccgtcttcgccgaggttccggcgctgcaggagctccggcggacgttgctgggctccaagagcgtgtcgttccaccacgcgcctgtgtttgggctggtgtgcggcttggttggattcgacggcgagacggcgcagcgggcgtacatgttcgtgacgatgagggacgtgctctctgccgcgacgaggctcaatctgatcggcccgctggctgcttcggtgctgcagcaccagcttgcgccggatgccgagaggatggtgcggaaatggagggaccgtgatgtctctgaggcgtcacagactgccccgctgctcgatgccgtgcagggctgccacgcttacatgttctccaggctgttttgttcgtgacaacaaggatcacatcgacaggagccaacgacagctgtcttctcataaaaaaaaagcaccaggtgagtacaagaatcccaggaacagattcattatgcctcatactgaccctcgtcgttattttcatgcaaacttgtacaacagagatgcaatagtgcatcattagtatcagggttgtaccctctctaccatctattacaccatcatagcatcgtcccatatattcaacggttacagaacacaaacatttgcatgtcaagtgtcacaaagaacacgcttcatt

SEQ ID NO: 143 - DNA, 962 bp, Zea Mays
gtgttcgatggaatgcgtagctgacaattatttcgccctttttcagtaccgaagatctcccatccgctctgtcgatttgcaatggagcccggcagcccagccccgaagaaatcacggctggtgcactcagcggactgcgaaatggaggaggcgcaggcgccttccagttccaatgcagcggggggcgtgaaccagagcttgcactggacccagtggcagatcctggactccatcctcccgaccggcggcttcgcgcactcgtacggcctcgaggccgccatgcagtcccgcgtggtgaacgaccaggaggacctgaggtcgttcgtcgtccaggtcctcgacagcgccggcagcctgctgctgccgttcgtgcactgcgcatgcgcaggcaagtcccccggcgacgcagcggcgtgggccaagctggaccggttgctggacgccacgttgacgaacgaggtcgccaggaaggcgtccgcggctcagggctcggctctgctgcgggtggccgcgtccgtcttcgccgaggttccggcgctgcaggagctccggcggacgttgctgggctccaagagcgtgtcgttccaccacgcgcctgtgtttgggctggtgtgcggcttggttggattcgacggcgagacggcgcagcgggcgtacatgttcgtgacgatgagggacgtgctctctgccgcgacgaggctcaatctgatcggcccgctggctgcttcggtgctgcagcaccagcttgcgccggatgccgagaggatggtgcggaaatggagggaccgtgatgtctctgaggcgtcacagactgccccgctgctcgatgccgtgcagggctgccacgcttacatgttctccaggctgttttgttcgtgacaacaaggtgagctacctaccttcgtatgatctttgagcatatgcagcacattcaaagatgctccggtcatgcttccatgctt

SEQ ID NO: 144 - DNA, 679 bp, Zea Mays
gagaagtgaaggcaagcaagggcactgggtgggaaaacctgtgctagcttgccggcaatggcgcgccgggtgctgccgctgcggtgcaagcgctgcaatgcattcacaactaggcacatgatgtgtttcaccagagtctctctgtgagtagtgagtgactactaactagggaacccctagatcgagctcgtcccatttcggagggggcagcacatgggatgggcgtggcagaatcggccgcgggcggccaaggggagcagctagatagcgggccagtgctctgctgccgccggagatggaaaggatattcgccgctgcgagcggacagcggagacaaggcctccggcgtccggggatgtgcatggctccagaaggaacgaaggcggttgtactagtcttgttgtagacctgcgaacacacgacgacgagtgtgccgtggtgtgggcatgcaaaacttgacgggtggagctgggcatggcatgggtactcgacgaaagtgttgctgaaccgtgccggcggagattcactgctacggccgttttttatatataaaaaagttaatctttcaaaatttcacatttacatatatatatcatgtgctcaaaatctcgggagcctttggaaggtgacgagacgagacatatgtccattgagcccacataggctgggttgggtgtta

SEQ ID NO: 145 - DNA, 900 bp, Zea Mays
atggctgacatggtctctggggttgctagccagggggctaggcctgctcttaggtggagtgccacaatgtctgggtttgttctacgccgatttgttgacttgataggtactggggttaggactgacaagggttttaaggaaatccaccttaactctgttgctaaaaatgtctccgagttctgtggccaagaagtaacaggccagcaagtgtacaatcaccttcgtaagtggaggtctaggtgggtcaaagtttgcaaactaaaggacattagtggcgctctttgggatgaggatacctttgtcataagcttagaagagggtcattatgctgcttacatcaaggatcacccaaaagatgctgattacctcaataggcccatagagaactatatggctatgcaaatcatttttggaagtggggttgccactggtaggtttgcaatgggttcaaatgagcctttgggcaagccaagtgacattgttgacatcttagatgatggcattgaagtgacctcagagtttgttgatgcttccaatctaactggcaagggaaagactgttgataagggtacccctagtgactccattgataccaagcctatgtccaacttagggaagagaaagaggtacatgactgatgaagatgttgtcgtgttcaatgggatgaaagaggttgtatctgatgttgctgctgctgtccgtgaaagcatccatgctgaagcagcacctgggatctacaatgctgtaatcaactgtcctgggttctctagggaggctctcatgtatgccctaaaccacatgatggagcacaaggccacctccctagtgttcctggacatgactcctgatgatcgtgacctatggctcaagacttttctagccaagcactaccacaactga

SEQ ID NO: 146 - DNA, 3311 bp, Zea Mays
atgttgccgccgccgccaccaccgtcctccttgcgcgaccttctctcgcgggagcgcgtcgacgaggacgaggcgccgcatctgtcgccgcgacgcgcctccgggcggtcacccccgcgccgcggggcgtcgtcgaggtcgtccaggcacacgtcgtcgccgccgctggccacgaccacgacaacgaccagggaggcggagggggaggccgccgccgccgacgcggtggtcgccgtgctgtccgcgtacgccgggaggctgctcagggacgcggaattcaggcgggcgctccgcgacaagtgcgccgcgtgcctcgcgcccgccgcgggcgcgggcgaggacgacgacgcggcggcaggccgccccgtgctggccaacctcgagctgggcatcgagagcatagagcgcctggccgcggacggctccgccgcgcagccacaggcgccgcgcgacgccaagatccggtcgctccgcaactccatccgcctcctcagcgtcgtcgcgtcgctccactcgccaccgccgccgccgcgccccggcgccgccgcgggggacggcggcggccgcacctgcggggtgcccaactcgcacctcgcagcctgcgcgcagctctacctcgccgtggtgtacaagatggagcgcaacgaccgcgtcgcggcgcgccacctcatgcaggtgttcgccgacgcgccgggcctcgcgcgcagggagctgctgccggacctctgggaccacgtgttcctgccccacctgctccacctcaaggtctggttcgccagggaggccgacgacctcgtcgctggccgggacgccgacgaccggcgcacgaggatgaaggccctgcagaggctctacagcgaccacatggacagcggcacggctcagttcgctgtgtactacaaggagtggctccagtcaggcgccgccgcgccgcctcccgtcccctcggtgccgttgccttcgacgcccaggagtttcgacgggcgcgagaagagctcggcttcggtgcacagaacctccatcaacagagacctgtataatgcggttttcgggacagctctcgctctcgggcaggaagacgtcaaggatacaaagctggacgatgggactggactagctctggatttggatgtcgaattggatcacgatgctgcgggcttcaagacacagaagcttgctcatagtaaaatggggctccaggaaaagcactcccgctctcggaaagaaggcgccgctctagcagaaacagcacctgcgcagcggaaatcatactcctttcgactgttctcgtgccaaggcgatataagcaggaacgtgatcagccatcccaaagcagcgaagaaggaacccgtggtgtctgtcgagaaagagctggacagcagcgagctagctcctgctgtcgtgcctctgctggaacgagcggtttccgtggtatccagttcggacagcctgagtcagtgcgaggacgccgtgcacgaggtcgccagagcatgctcggcctgggacccgagcctcgtgaacctgctgtcgtgcgcctctttcatccaaggccttctcgaggtcacgctgacctccaaagacgacgccgtgctggagtcggccatgtcgatcatggggaagctggttctggggaacgaggtgatcagacagctcgtgctcaacgcggacccgcagctggaggttttcctgaggctcctgaggagcagcgagctgttcctcaaggcggccgtggtgctctacatgatgaagcctaaggccaagcagatgctgtccctggactgggtgccgctcgtgctgcacgtactggagtgcggcgacgaggtgcagtctctgttctccgtaagatgcgcccccaagatcgccgcgttctatttcctggaccagctgctcatggggttcgacgttgacagaaacgtcgagaacgcgaagcagatgatcgctctcggtgggctggacctcctgatcggcaggcttggcgctggcgacgctcgcgagagcaggcactgcatcgctctcctgaccacgtgcgttcaggccgatggcagctgcaggcactacttggctgatagtctcaagaaggagcctctcgttcagcttcttgctggaaatcagaggaaagccagtgccgcgtcccttaacctgatgagtgaactcgtctgccttaacagaacaagcaaaatcgtggagttcgtcaaggagctgaagaacagcgggtgcttgaacacgatgcacgttctgctggtctacctccagcaggctcctctcgtccagcacccgttagcagctaccatgctactccagctcgatctcctgggtgatccttcgcagtacagcgtgtacagggaggaggcgatcgaggccatcgtagccgctctggagcacagctcgcagagcaggaaggtccaggaacagtgcgcccgagctctcctaatcttggcagggcggttctcgtcttcaggagagcccgtagcagaagcgtggctgctaaagagagcgggcctagacgattccctctctgagtccttcaggagatcagaagtattcaaagataagagtgttcgagcggaggaagagaagctagtggaagaacggcagaagaacctcgccttgatgctactgaagagcgggggcagaaggttcctcacggcgctgtcgagctgcatatccgatggaaccccgagcctcagccggtcgtgcctcgtcagcgtggcatggatgagcagctccctctcgccgctgcgcggatgcaacgacttccagcccctggcatgctccgtcctcgcgtctaagcttttggacagcttgagctacgacagagtcctggaggagagggtgctcgcttcgctgtcgcttctgaacgtcgtgagacacccagaatgcatggagaaggtcttcccgctgaagaaagaaaccatcgagtcactccaagatctcgcggaggtgacgtggactgcgaaggagctcctctttgcctgctgcagatgagatgcaagaccagatcgtcctcagcgatgaagaactagacaccagcatgtaattggaagtgattgttttgggagaagagtgatcgccactgctgtacacagattgtttcgtacttccgttgatatgtgaagccccacagatcctttccctcgtcatggactttggctttcgctgttgaattgaagcctgcacatggcttcctttcttcttcttctttagggcttgtttagattgccaggtatccatatcaatacacatccatgtgttgtacgttaacacacaacatactatattgagttggataatgatcatccaaataagtcctt

SEQ ID NO: 147 - DNA, 2819 bp, Zea Mays
acgactcacgaattccgtcccattcccatccgcgcggacgtctcctcacgcaacctgtagccgagaccctctcacacgcttgcgatctccacctccgcggttgccggccgacctcttccccgccgcctccgccgcgcctcggggcaccggacccgtctccaacccctagatctcgcgccccctccgccccgccggccggtggtcacgccccgcctctcccgccgccggacgagctcgccgtggggcggagaggtcgccgccggcgacaggagccacgcgatgtccagggaatcctgccctttctcctcgcctcagtccttggggatccatccgtgctaatttccaccgttggcttgcagccttttgtatcgagcatgtgctaaattgggcacgcagaaatatcatcaagtatgctgatattaccgttccgaaacatcccaacttgccagcattggtcggggtaaatttgtcaagttatcaattgaagtgtgcttggttattgatttccattaaattgcagcatagcttgctcttcatctgaaagttttcgagggtagatgtttatcgtgcaccatggtcgttggtaatgacatagttgacatggttgggtgctaaaaggacgagaagggtttgaataaacggtccgatgaacattctacttgagcttaagcatctcaagctctttagcatgcccgcaagacctgtcatctgtaaaggccttctgatagtgattgcccttattttgttgagagcaattgtatctccttttcttgctatagattcatctgagaagaaagaattttacgagtccacagcccctgacttgcttcctagaattagacgagacaagtttcttgaggtcccacagatcatatgggggttgaacaatcagaagattgcattcgccagagcatgcttgactgcaagattcctgaacagatcccttctcatgccaagcttgagtgcttctctcttctacaaagaggttgacttgctgcagcctgtcagttttgacaaagtgtttgactttaacaagttcaatgcgcgttgccatggcttcgtaaggttagctcagtattcagaagtttcaaatcggacagagcccttcaaactccaaaaggggaccggtagaaggtggacggcagacagagatttggatcaactacagcaatccataggcagcaatgtggatgactctgaagtcattgaaatcgttgggaaaaatccatttctgtggcctgaccactggccagtcaaagactatgccaaaatcttcgattgccttgtcttagttcctgagatagaaaccgaagtggtcaaggtgatatccaagattagagaggcaggccaaagagcaagacatgaagctgggggttctcatagtaagcagaggagagatagctcaacgaatccgcctgtaccgtatgttgctgttcacatgagaatagaaaaagattggatgatacattgcaagaagtgggagcagcggtccaagtcacatgaaatctgcagtagtaaagaagagatcattcataaggtctcacagatcactgacctacgtcggccggttgttgtttatcttgcggtagctgacagccttcttgaagacgattcaataaccagtgggtggagagtgggtatggttgcttacgagaagaagaagcttggtgttactgacatctacgatcgtcagccatatcttataaagtctgccatcgacttcgaggtgtgctcgagagcagacgtgtttgtcggcaacagcttctcaacattctccaacctcgtagtgctgtccaggacagaaaggctgtacaacctgggaaaggcgagctcgtgtggcgagaacatcgggctttcgtcgtatgcgtacaatgtcatgggcgacgatggtggaccacagagatggatgacagatatgtcggacacaagcctgcagaggttaagttacggaacaaataacgtctcatgccactgactttgacgcatagcaaacttgactgaacatgatgtatacctgaggaagagtccttgcccgacttcgctttttatcggcaaaggaagcaagtatgtgcagctaatttgacgtgcttctgtgttcgaagctagagcccacatgtcgcacttgtgaaggactatggccaagagtttagatgtgcttaaaagtgttgacagtgttgggcagtttgtagtttgtataacgctgaatgctgcgcgatggcttttacctgggacccttttgtttttttatggtttcagaatcagacctacacattcaagtgtattttgttcacatgcagcgtgtgtgtttttaagatggtttgctgtgttctgactttttttatttcaatcgccctcaatgcagtaaacctccttgcaaaaaggaccagatgcttgctatttctccaggtttggaactgtgtgagaaataggggttggtgggaagattatttggcgatttttttttctcttccatccgatttttatataatatgaggatagcctgtgtagcagtgagagctatctttattgagtaaccagatcatgcagtcttttcgtatttgcgggatgaagacaatgcggggtgaacacaatgcaaagtgaagattttgtttgctttatgaccattagagtttatattagagcctctggcacttctgtttttctttaaaactagaatcttgataaatgtaactgaatttctatctcctggttcaaatgtaaatgcaatgggcatcttgccctgtttaatcatttttgaagtgcgtgtagatttagctaaagtttttgacagaattgaatggaacttaattatgtctgct

SEQ ID NO: 148 - DNA, 897 bp, Zea Mays
ccaccaccaccacaacgccgccagcaccgaacagtggcagtatcggcagaaaggcgcggcggttcggtccgaagagcacggtgacatcgctcgcgccggcgtccacggtcggcggctccgccctcgcgctgcactacgcgaacatcgtcatcgtcgtcgagaagctgctccggtacccgcacctcgtgggcgaggaggcgcgggacgagctgtaccagatgctgccgcggagcctgaagctggcgctgaggaagagcctgagagcccgcgcgaggagcacggcgatctacgacgcgttcctggcgcacgactggcgggagacgctcgagaagacgacgctggcgtggctcgcccccatggcccacaacacggtccggtggcaggccgagcggagcttcgagttcgaacagcagcagcagcgggtcgtgtcggagcggagcgtgctgctgctgcagacgctgtacttcgccgaccgggagaagacggaggcggcggtctgcgagctgctcgtcggcctgaactacatctgccggtacgagcggcagcagaacgcgttgcttgactgctctagcagtgacttcgatgattgtgtagaatggcaagtccaatagagccgaaagccaaggtcaggtctctgctctggtccgtagtgtatacaacaagtgatgtgattcagcgaagggtacttgtgatttggttttgcttgttttctctttttttttgctacgttgttcttggcgcatttttcacatgatatcatcgtctattgttagatgaaatgtagaggtttgtgaactggaaagaccctctccggttgtgcataattaatcttgtagaatcattgtgtgaagcaacctgaaaacaggtttggtacttagtaaagtacagctgacagac

SEQ ID NO: 149 - DNA, 1440 bp, Zea Mays
gtggttcgtttagctccgtctccgtggagagcctctctcgcggataaccggtaggcactgccaaggggacggcggcgcctggtgccgtcggccagcgcggctgcgcggtgcgcgcgtctcgccgactcgatgtgccgttgcgtgttcgttcgtttcttggactacagtttcttactttctttggagaaaagtccgctgtttagaaattaagcttcggatctgaaataagcttctagattgtggaatgacgcgtcttttctgactagtagctcgcatataattctttctttacgaaaaggactccaggtggttacttgggatctacgtgctccaagaaatgagcaatagccagtaggaatccgtaagctgcgagaccaatcttcatatttactctgaaacagtatggacagtggtaaacttttttctcacgagctgcagtcataattcgagagtaacaagcagcggatgtcgtaatggttagattggatggatggatgctactagtgtagaaaccacttgatgatggttacctgcctacagtcaacccattcaacctcaaatgttccttgtgaggtatcatgacagaacagcaggaaggtgttagcaagagctcttcctcaagtattagcagcagcactcaggagagtgaggaggaactgaccatcggtacccttataaccgaagcaacaaacacaacaaacagtgccaagagtcttggaaagcgcctttcacacttagattcgatcccgcacactccacgtgttaatgggaaaattccagattttaataatgcgacaattgatcatgaatcattattagaaagattaggcacttatggcttagctgaatatcaaatagaaggagatgggaattgccagtttcgagctctggcagaccagatattccgcaatcctgactatcacaaacatgtgaggaaggcggtagtgaagcagctgaaggagttcaggaaacactatgaaggttatgtgccaatggaatataaggtttacttgaagaaaatgaaaaggtctggggaatggggtgatcatgtgaccttacaggcagctgcagacaggagctttggctaagtttctggtgtgaagtacactacaattcattgtatgcagttgaagatcttccaacacggaaaactaagaagaagcattggctgttctagctcgccaggctttggtgatttcttggtatgctattggtcttctctttgtagtccagcagcatctgtaagcctgcttagttatgcctttgtttgttgtaagttgtaacttgacctggaatcaaattcatttaagatcatgcaaaatacagtgagctcttgcttcgtccttggctgaaatatttccagcacatagtaaacatgttttcagggacctattttttattttttttggggggggggggggggggtattttgcttcgtag

SEQ ID NO: 150 - DNA, 1249 bp, Zea Mays
atcccaaggtcatttcggttaatctccacacgcatcgcggacacggagacttgccttccttttggtgcggaaaaagaaagagaggagaagcgaaggaggttctcagttggagcggctccctctccccgcgcgcgccaccgcctccgatccgagcagccgcctacagtcaacccattcaacctcaaatgttccttgtgaggtatcatgacagaacagcaggaaggtgttagcaagagctcttcctcaagtattagcagcagcactcaggagagtgaggaggaactgaccatcggtacccttataaccgaagcaacaaacacaacaaacagtgccaagagtcttggaaagcgcctttcacacttagattcgatcccgcacactccacgtgttaatgggaaaattccagattttaataatgcgacaattgatcatgaatcattattagaaagattaggcacttatggcttagctgaatatcaaatagaaggagatgggaattgccagtttcgagctctggcagaccagatattccgcaatcctgactatcacaaacatgtgaggaaggcggtagtgaagcagctgaaggagttcaggaaacactatgaaggttatgtgccaatggaatataaggtttacttgaagaaaatgaaaaggtctggggaatggggtgatcatgtgaccttacaggcagctgcagacaggtttgctgctaaaatatgtctgttgacatcgtttagagacacatgcctagttgagatagtccccagagatgccactccaacaagagagttttgttaagtttctggaatccacatgcacaatacaaggtcagtaaattttagtgtaagatttggtgcctcattatttgcttgtacctttttgcagagctttggctaagtttctggtgtgaagtacactacaattcattgtatgcagttgaagatcttccaacacggaaaactaagaagaagcattggctgttctagctcgccaggctttggtgatttcttggtatgctattggtcttctctttgtagtccagcagcatctgtaagcctgcttagttatgcctttgtttgttgtaagttgtaacttgacctggaatcaaattcatttaagatcatgcaaaatacagtgagctcttgcttcgtccttggctgaaatatttccagcacatagtaaacatgttttcagggacctattttttattttttttggggggggggggggggggtattttgcttcgtag

SEQ ID NO: 151 - DNA, 1151 bp, Zea Mays
atcccaaggtcatttcggttaatctccacacgcatcgcggacacggagacttgccttccttttggtgcggaaaaagaaagagaggagaagcgaaggaggttctcagttggagcggctccctctccccgcgcgcgccaccgcctccgatccgagcagccgcctacagtcaacccattcaacctcaaatgttccttgtgaggtatcatgacagaacagcaggaaggtgttagcaagagctcttcctcaagtattagcagcagcactcaggagagtgaggaggaactgaccatcggtacccttataaccgaagcaacaaacacaacaaacagtgccaagagtcttggaaagcgcctttcacacttagattcgatcccgcacactccacgtgttaatgggaaaattccagattttaataatgcgacaattgatcatgaatcattattagaaagattaggcacttatggcttagctgaatatcaaatagaaggagatgggaattgccagtttcgagctctggcagaccagatattccgcaatcctgactatcacaaacatgtgaggaaggcggtagtgaagcagctgaaggagttcaggaaacactatgaaggttatgtgccaatggaatataaggtttacttgaagaaaatgaaaaggtctggggaatggggtgatcatgtgaccttacaggcagctgcagacaggtttgctgctaaaatatgtctgttgacatcgtttagagacacatgcctagttgagatagtccccagagatgccactccaacaagagagctttggctaagtttctggtgtgaagtacactacaattcattgtatgcagttgaagatcttccaacacggaaaactaagaagaagcattggctgttctagctcgccaggctttggtgatttcttggtatgctattggtcttctctttgtagtccagcagcatctgtaagcctgcttagttatgcctttgtttgttgtaagttgtaacttgacctggaatcaaattcatttaagatcatgcaaaatacagtgagctcttgcttcgtccttggctgaaatatttccagcacatagtaaacatgttttcagggacctattttttattttttttggggggggggggggggggtattttgcttcgtag

SEQ ID NO: 152 - DNA, 1146 bp, Zea Mays
atcccaaggtcatttcggttaatctccacacgcatcgcggacacggagacttgccttccttttggtgcggaaaaagaaagagaggagaagcgaaggaggttctcagttggagcggctccctctccccgcgcgcgccaccgcctccgatccgagcagccgcctacagtcaacccattcaacctcaaatgttccttgtgaggtatcatgacagaacagcaggaaggtgttagcaagagctcttcctcaagtattagcagcagcactcaggagagtgaggaggaactgaccatcggtacccttataaccgaagcaacaaacacaacaaacagtgccaagagtcttggaaagcgcctttcacacttagattcgatcccgcacactccacgtgttaatgggaaaattccagattttaataatgcgacaattgatcatgaatcattattagaaaggcacttatggcttagctgaatatcaaatagaaggagatgggaattgccagtttcgagctctggcagaccagatattccgcaatcctgactatcacaaacatgtgaggaaggcggtagtgaagcagctgaaggagttcaggaaacactatgaaggttatgtgccaatggaatataaggtttacttgaagaaaatgaaaaggtctggggaatggggtgatcatgtgaccttacaggcagctgcagacaggtttgctgctaaaatatgtctgttgacatcgtttagagacacatgcctagttgagatagtccccagagatgccactccaacaagagagctttggctaagtttctggtgtgaagtacactacaattcattgtatgcagttgaagatcttccaacacggaaaactaagaagaagcattggctgttctagctcgccaggctttggtgatttcttggtatgctattggtcttctctttgtagtccagcagcatctgtaagcctgcttagttatgcctttgtttgttgtaagttgtaacttgacctggaatcaaattcatttaagatcatgcaaaatacagtgagctcttgcttcgtccttggctgaaatatttccagcacatagtaaacatgttttcagggacctattttttattttttttggggggggggggggggggtattttgcttcgtag

SEQ ID NO: 153 - DNA, 1210 bp, Zea Mays
atcccaaggtcatttcggttaatctccacacgcatcgcggacacggagacttgccttccttttggtgcggaaaaagaaagagaggagaagcgaaggaggttctcagttggagcggctccctctccccgcgcgcgccaccgcctccgatccgagcagccgcctacagtcaacccattcaacctcaaatgttccttgtgaggtatcatgacagaacagcaggaaggtgttagcaagagctcttcctcaagtattagcagcagcactcaggagagtgaggaggaactgaccatcggtacccttataaccgaagcaacaaacacaacaaacagtgccaagagtcttggaaagcgcctttcacacttagattcgatcccgcacactccacgtgttaatgggaaaattccagattttaataatgcgacaattgatcatgaatcattattagaaagattaggcacttatggcttagctgaatatcaaatagaaggagatgggaattgccagacttaataggtcgtcgggagggggagtactattgcttcaatccatcttctacttagttgtttcgagctctggcagaccagatattccgcaatcctgactatcacaaacatgtgaggaaggcggtagtgaagcagctgaaggagttcaggaaacactatgaaggttatgtgccaatggaatataaggtttacttgaagaaaatgaaaaggtctggggaatggggtgatcatgtgaccttacaggcagctgcagacaggtttgctgctaaaatatgtctgttgacatcgtttagagacacatgcctagttgagatagtccccagagatgccactccaacaagagagctttggctaagtttctggtgtgaagtacactacaattcattgtatgcagttgaagatcttccaacacggaaaactaagaagaagcattggctgttctagctcgccaggctttggtgatttcttggtatgctattggtcttctctttgtagtccagcagcatctgtaagcctgcttagttatgcctttgtttgttgtaagttgtaacttgacctggaatcaaattcatttaagatcatgcaaaatacagtgagctcttgcttcgtccttggctgaaatatttccagcacatagtaaacatgttttcagggacctattttttattttttttggggggggggggggggggtattttgcttcgtag

SEQ ID NO: 154 - DNA, 596 bp, Zea Mays
atcccaaggtcatttcggttaatctccacacgcatcgcggacacggagacttgccttccttttggtgcggaaaaagaaagagaggagaagcgaaggaggttctcagttggagcggctccctctccccgcgcgcgccaccgcctccgatccgagcagccgcctacagtcaacccattcaacctcaaatgttccttgtgaggtatcatgacagaacagcaggaaggtgttagcaagagctcttcctcaagtattagcagcagcactcaggagagtgaggaggaactgaccatcggtacccttataaccgaagcaacaaacacaacaaacagtgccaagagtcttggaaagcgcctttcacacttagattcgatcccgcacactccacgtgttaatgggaaaattccagattttaataatgcgacaattgatcatgaatcattattagaaagattaggcacttatggcttagctgaatatcaaatagaaggagatgggaattgccaggttagctttttgtatcatgtacagaattaccttttcatttgtatgaagtaaatttatcgagatatattattattactctacatcaataatct

SEQ ID NO: 155 - DNA, 1361 bp, Zea Mays
cgctgtggttggccaatcctgacacattatcttctcatccaagccgagagcgtgaccagctcacccagatcagaatccagacctcgtcagagagcattcccttgtgcatctcggcctctccttcctcccttcctcgcccgcccagtcctctaaccatcttctccaaacgcccggagatggtctcgctgcgatgcaccaccgcgcaccactccctcctcggctcgccgacctgcctcgcgcgcccgcggcggcggccgtgccccgtcgtgcgcgctgccgtcgccgtggaggccggcgctcaggccaaggtctcactcatccggattgggacgcgtgggagtcctctggctcttgcacaagcccatgaaactcgggaaaaactgaaagccgcacactctgagttagctgaggagggggctattgagatcgtcatcataaagaccacaggagacatgatcttggacaaaccccttgcagatattggaggcaagggtttattcaccaaggagatagatgatgcactcttgcagggaaggattgatatagctgtgcactctatgaaagatgttccaacatatctacctgaaggcacaatattgccctgtaacctcccacgagaagatgtaagagatgcattcatatgcttgactgcaaattcgctcgcggagcttcctgctggcagtgttgttggaagtgcttccttgcggagacaatctcagattctctacagatatccatcactgaaagtagttaacttcagaggaaatgttcagacacggttaaggaaactcaaggaaggagatgtgtctgctacattgttggcgctggctggattaaggcggctaaaaatggcagaaaatgcaacagctgtactatcagtggaagaaatgcttccggcagttgcccaaggtgctattggaatcgcttgccgaagcaacgatgacaaaatgatggagtatctgtcctcgttgaaccacgaggataccagactagctgtcacatgcgaaagagaattcttggcagttcttgatggcaactgccgaactccaattgcggcctatgcttaccgtgacaaggacgggaactgctcattccggggcctactgtcttcaccagacggatctaaagtatttgagacggcaagaagtggaccgtactctttcgacgacatggtcgagatgggcaaagacgctggccacgagctgaggcgaaggctgggcctggcttcttcgatagccttcaatgaacagaatgtgcggccatgcgcgatttcagttggcaccctttcggttgaaaacgagggccaaagtaggttgttgaggggtttgtttttgtttcttctttttttctcctactactag

SEQ ID NO: 156 - DNA, 1907 bp, Zea Mays
cgctgtggttggccaatcctgacacattatcttctcatccaagccgagagcgtgaccagctcacccagatcagaatccagacctcgtcagagagcattcccttgtgcatctcggcctctccttcctcccttcctcgcccgcccagtcctctaaccatcttctccaaacgcccggagatggtctcgctgcgatgcaccaccgcgcaccactccctcctcggctcgccgacctgcctcgcgcgcccgcggcggcggccgtgccccgtcgtgcgcgctgccgtcgccgtggaggccggcgctcaggccaaggtctcactcatccggattgggacgcgtgggagtcctctggctcttgcacaagcccatgaaactcgggaaaaactgaaagccgcacactctgagttagctgaggagggggctattgagatcgtcatcataaagaccacaggagacatgatcttggacaaaccccttgcagatattggaggcaagggtttattcaccaaggagatagatgatgcactcttgcagggaaggattgatatagctgtgcactctatgaaagatgttccaacatatctacctgaaggcacaatattgccctgtaacctcccacgagaagatgtaagagatgcattcatatgcttgactgcaaattcgctcgcggagcttcctgctggcagtgttgttggaagtgcttccttgcggagacaatctcagattctctacagatatccatcactgaaagtagttaacttcagaggaaatgttcagacacggttaaggaaactcaaggaaggagatgtgtctgctacattgttggcgctggctggattaaggcggctaaaaatggcagaaaatgcaacagctgtactatcagtggaagaaatgcttccggcagttgcccaaggtgctattggaatcgcttgccgaagcaacgatgacaaaatgatggagtatctgtcctcgttgaaccacgaggataccagactagctgtcacatgcgaaagagaattcttggcagttcttgatggcaactgccgaactccaattgcggcctatgcttaccgtgacaaggacgggaactgctcattccggggcctactgtcttcaccagacggatctaaagtatttgagacggcaagaagtggaccgtactctttcgacgacatggtcgagatgggcaaagacgctggccacgagctgaaggcgaaggctgggcctggcttcttcgatagccttcaatgaacagaatgtgcggccatgcgcgatttcagttggcaccctttcggttgaaaacgagggccaaagtaggttgttgaggggtttgtttttgtttcttctttttttctcctactactagttcctgctagagccttgtactaccactcatgttgagcagccccattcagcttttgttgtttctcatgttcttttagcactctgggttagagagagccggtatctgcacagctatgttgtgtcgaagttgatgtgactctgcagatagttgttgtttcaagaatatttgagcgagctcatgataaccatgggagtaagattcgatgttcctattcttcggaaaattagccttgttgattgattctcagatgaacctgatgaatgtcacatccctctttgggggaaatgagaatggagaaacctgcctctttcatgaatgtcacatacacccctaaatgttccagtttttttttttaaaaaaattaaacaaatatgattcctttttattattattttctgcaatcacatagaggcaagatgaacacaaaggcaacaccggcactctttcacaatattggagataactgatagtctgatacaggtcccaatctaaattacccagacattttcagatgctactgaacaaggatctcctgaagcatctta

SEQ ID NO: 157 - DNA, 1908 bp, Zea Mays
gtggttggccaatcctgacacattatcttctcatccaagccgagagcgtgaccagctcacccagatcagaatccagacctcgtcagagagcattcccttgtgcatctcggcctctccttcctcccttcctcgcccgcccagtcctctaaccatcttctccaaacgcccggagatggtctcgctgcgatgcaccaccgcgcaccactccctcctcggctcgccgacctgcctcgcgcgcccgcggcggcggccgtgccccgtcgtgcgcgctgccgtcgccgtggaggccggcgctcaggccaaggtctcactcatccggattgggacgcgtgggaggacagtcctctggctcttgcacaagcccatgaaactcgggaaaaactgaaagccgcacactctgagttagctgaggagggggctattgagatcgtcatcataaagaccacaggagacatgatcttggacaaaccccttgcagatattggaggcaagggtttattcaccaaggagatagatgatgcactcttgcagggaaggattgatatagctgtgcactctatgaaagatgttccaacatatctacctgaaggcacaatattgccctgtaacctcccacgagaagatgtaagagatgcattcatatgcttgactgcaaattcgctcgcggagcttcctgctggcagtgttgttggaagtgcttccttgcggagacaatctcagattctctacagatatccatcactgaaagtagttaacttcagaggaaatgttcagacacggttaaggaaactcaaggaaggagatgtgtctgctacattgttggcgctggctggattaaggcggctaaaaatggcagaaaatgcaacagctgtactatcagtggaagaaatgcttccggcagttgcccaaggtgctattggaatcgcttgccgaagcaacgatgacaaaatgatggagtatctgtcctcgttgaaccacgaggataccagactagctgtcacatgcgaaagagaattcttggcagttcttgatggcaactgccgaactccaattgcggcctatgcttaccgtgacaaggacgggaactgctcattccggggcctactgtcttcaccagacggatctaaagtatttgagacggcaagaagtggaccgtactctttcgacgacatggtcgagatgggcaaagacgctggccacgagctgaaggcgaaggctgggcctggcttcttcgatagccttcaatgaacagaatgtgcggccatgcgcgatttcagttggcaccctttcggttgaaaacgagggccaaagtaggttgttgaggggtttgtttttgtttcttctttttttctcctactactagttcctgctagagccttgtactaccactcatgttgagcagccccattcagcttttgttgtttctcatgttcttttagcactctgggttagagagagccggtatctgcacagctatgttgtgtcgaagttgatgtgactctgcagatagttgttgtttcaagaatatttgagcgagctcatgataaccatgggagtaagattcgatgttcctattcttcggaaaattagccttgttgattgattctcagatgaacctgatgaatgtcacatccctctttgggggaaatgagaatggagaaacctgcctctttcatgaatgtcacatacacccctaaatgttccagtttttttttttaaaaaaattaaacaaatatgattcctttttattattattttctgcaatcacatagaggcaagatgaacacaaaggcaacaccggcactctttcacaatattggagataactgatagtctgatacaggtcccaatctaaattacccagacattttcagatgctactgaacaaggatctcctgaagcatctta

SEQ ID NO: 158 - DNA, 786 bp, Zea Mays
aatacaacaacagcagcagcagcagtcttttagcccaagtaagttagggtaggctagagctgaaactcaatagaaaccacaagtcaaggttcaaagttcaaacacattttgggtttcacctttattaaaatagctagctttaacatgggctggacaaacctatcaggctatcacaaccctcctcctgttcctccctttccacaagttcgagtggtaacaatctgtcattctatatcttcagtagaaactgtgaattcaacagaagtactgcagtttgaccatgtttatgatgcttttaacattctctgtaggttatgtattggagaagagtcgcggacagaattcagatgctgaagtcagcaattttacatcccgagctgaattccagagcataacctactggaatcacgatacagcgccatcagcagaggattccctcccgaggtgcttccattggcttaccgtcgctaatgcgatgcatagagcagtgactgctgaagacctgactaacatggcagcaatgcagaatcaggacaagtagattcgttctataacgaagccatgcaatttcgatttggtgaaccatctcgacaaaggatcttgtaacaaccaacatgttatttgaacgcatccagtaggtaatgtttaggctttggggtaagatgcttcaggagatccttgttcagtagcatctgaaaatgtctgggtaatttagattgggacctgtatcagactatcagttatctccaatattgtgaaagagtgccggtgttgcctttgtgttca

SEQ ID NO: 159 - DNA, 785 bp, Zea Mays
gtttttcttcctgtggtcgctcgttgagtgcggaaattccacgaacgtgagctcaacatggagccggcgacccctccggcacccgccgccggcgtcacggctaccgtcgacctctcctcagtcgcagccgacctcggtggggcgcacctcctgccctgcggcatcaggcagaacggcggcgcccccgtatccgactacttcaagcctagggacacaggtgtggaggtggagggggtgaagatggaagaggccttctttcgtgggaggaaactgcagggcactaccctagctctcccggatggctaccgaggttatgtattggagaagagtcgcggacagaattcagatgctgaagtcagcaattttacatcccgagctgaattccagagcataacctactggaatcacgatacagcgccatcagcagaggattccctcccgaggtgcttccattggcttaccgtcgctaatgcgatgcatagagcagtgactgctgaagacctgactaacatggcagcaatgcagaatcaggacaagtagattcgttctataacgaagccatgcaatttcgatttggtgaaccatctcgacaaaggatcttgtaacaaccaacatgttatttgaacgcatccagtaggtaatgtttaggctttggggtaagatgcttcaggagatccttgttcagtagcatctgaaaatgtctgggtaatttagattgggacctgtatcagactatcagttatctccaatattgtgaaagagtgccggtgttgcctttgtgttca

SEQ ID NO: 160 - DNA, 545 bp, Zea Mays
gtttttcttcctgtggtcgctcgttgagtgcggaaattccacgaacgtgagctcaacatggagccggcgacccctccggcacccgccgccggcgtcacggctaccgtcgacctctcctcagtcgcagccgacctcggtggggcgcacctcctgccctgcggcatcaggcagaacggcggcgcccccgtatccgactacttcaagcctagggacacaggtgtggaggtggagggggtgaagatggaagaggccttctttcgtgggaggaaactgcagggcactaccctagctctcccggatggctaccgaggttacatcactttcttccttctgccttcttcaagcctacaagatttctgagtttatcatcagtttgggacctttggagtgggaagcgtgttttttctcctttttcttcatcgattcgtagcaatgtacgttgatttatggcctgaatgatagtgaagctgtatagaatcagtgtaaccgtaactagatgcgccaaaatccgacattctctccaaattgcatgcacgcctttaagg

SEQ ID NO: 161 - DNA, 780 bp, Zea Mays
gggattgtgttgctgaaaattttagtttacattgatttggtgagaatctttctagcaacaatttcatatccttttagcacgtaaacacacttggttaacagtaccatagcccaccttgatcagcctcctatagctccactaaaaacctgaaccgggacgtttgacttgtgatcctttcgactgctttaccacctctatcgaagctgtcacaccagcaccatcacggtcctagagatcaagaaagagcttgggtaagtaagaggtgaggttaagtgttccacaaatactttcatattctacttcctattgcttccctttaacatggtaggatccaattcaagtgttcatggttctgaattgcatcagatagccgactcactcgtggcggccatggaaaggatgttaaatgaacgtctgtccacgataggaggtcgaaggctacatcattgtgatcctgaagaattgaaccatgaagaatccggagatgagaattctggtttcagccatgaattcgatcccttcggcgatggccgtagaggttatggtgatggtcgccacactaatttcgataatttgtgtggaaggcgtcatgcacacggacaccgagtaagatttgaagacgaggagtttgaagaccgtgatcgtgaggcatctgatgagaacccctttgcaaatgatggaatgtttggttggcatcatcatcaccaacatgctaactttgaagatagcgagagttatcatgggcatcgccatagaaatgacccaaacaatattgcctga

SEQ ID NO: 162 - DNA, 654 bp, Zea Mays
atggcggccacacacgccttctatcttttctatctactggtgaggccactcctggggtacttaagcagtagaatttatgtgtgtctctcatcatggggtttaattacggtctgttataacaatctgtccatccctatgttgtgcccggtagatgttgatttaggaactataggattaagtcaccaaaggaacttgttaatgattttgcataatgttttgggacaggaaatactaaactggttgtggcatgaggagggaaccatcaacatcagttggggacctgcctcctatagggagtttatatgtaaatgtgttgttataaatgttgaacatcggagcatgaggagggcaccattagcatcagttgggaacctgcctcctatggggagatgcgagtgcgacattactttgaaattgccaaaccaatctcttcatcgcagtaggcatcagcatgaggagggcaccatcagcatcagttgggaacgtacctgcatcctatggggaaagcatgaggagggtaccatcatcatcatagactcaaacctacccccctatggggagtcgcccctgcccacatccgcgtggatgttcattgctggcccgcatgacctctccaccctcttttgggtgcggtcccccaagaagtggttatga

SEQ ID NO: 163 - DNA, 228 bp, Zea Mays
atggagccggcgacccctccggcacccgccgccggcgtcactgctaccatcgacctctccctagtcgcagccgacctcggtggggcgcacctcctgccctgcggcatcaggcagaacggcggcgcccccgtatccgactacttcaagcctagggccacaggtccggatggctaccgaggtgacatcactttcttccttctgccttcttcaagcctacaagatttctga

SEQ ID NO: 164 - DNA, 566 bp, Zea Mays
ccctccctgtccgtggatgcagcagcacctccctccctctctgctcgtgcgcaggaaacccctcacgcacagggaagaacaacagcccaccctccaaaacaccaagcagcggcagcaacctccatggcgcccctgcttccatcccatagttgagcgcccttgctgttctcttcaatgccccttggatgttcgacggaatacccgtgagaaataatgtgttgtgcgcagccccgtccgtgatgccgtcgaccctcgctagtggtcgacgccgcgcttcgcgcttggcccgttcgacgaaacgccaagccttgtggacagcccatgtgactagcctcgattcgtctaggttgttcacttggtattttgtggattaatctatttaagctttggtcgatgttgtgcatgtgtgtatgtgtaagaaaatgtattggtatggattgaagttcgtggcgaaagaaaaagaagtagaaaagaactcggaggtttttatatttcgataggaatttatgcgatgtgttgtttgatgtgtgtgatttgtagtttgtataattatatttttgtcgata

SEQ ID NO: 165 - DNA, 1779 bp, Zea Mays
cgaccagagccagtccgctccgctccaccccttgctcacctccgcgacccgcaccaatggcgacgcccacggccccatcccacttacccctcgccaccgcctccgcgtccacctccttccccgaccgcttcctccgcacgccgtgcgcgctgcggccccgctcttggccccgcctgcgggcgggctccgtcaaggagtggcgcgagttcgaggacgacgcgggcgccgtcaaggagtggcgggagttcgaggacgccgtcaggaggaaggacctcccccgcgcgctccaattcctgcagtccgtggagcccgcggcggtgcaggtcgcggtccccgtgccgccggggcgggactgggaggtgctcgacgcctgcgtcgacgccgacgacatgcgcctcgtcggccgggcgtaccagttcctcgtcgaccgcggggtcctcgccagcttcggcaagtgcaagaacatcgttctggaatggccaagagaagtgacaccaacggttttgaaggagatgaccggtttggaagctgaaaaacttgcgccgaagaaatggggtctgtcgggaagttcaccgtatgttctcattggatttcttggaggcgtatcctttctactaacacaaggggtcgatctacggcctaaactgagtgctgtattgggattagcagcagccgatgcaatgttgctcggtggtacttgtcttgctcaaatctcatgtttctggcctccgtataaacgtcggatccttgtacacgaagcaggccatcttcttactgcttatctaatgggctgcccgatacgaggagtcattttggatccatttgtggcattgcgaatgggcatccagggccaggcagggactcaattctgggatgaaaagatggaaaaagaactagctgagggccatctatcaagcacagcgtttgacaggtactgcatgattatgttcgccggaattgctgctgaggcacttgtttacggggaggcagaaggtggagaaaacgacgagaacttattcaggagtctgtgcattctactgaacccaccccctgctgttgcacagatggcgaaccgagctcgatggtccgtcatgcagtcttacaacctcctgaagtggcacaagaaagctcatagagccgcagtcaaggcgctggaagacgggcacagtctcagcgttgtgatcagaaggatagaagaagccatcgcttctgacagcaaataaatatgaccgttgatcctttacatgtgttcttgtcaaccaagctttgttggcagcttccacaggacgcggaagaaggagaactttcttaattcgcgcgaagggttagtgtgtgttggaacatgagtggcgcttttcaaagaaagaaaggcagaagatccttggagctggagggaatagcggagaccacgaccagggcgtctgatggacggactagatcgagtgatacatccgttggagattttaaggaagtcaaaaggccgttgtgaacttgtgattagtgtcgatgccagatatggcagatgtgcatagggagatatgactatatgatgtcttgatgagtatgcagacatgagctattttgcaatggatggataagtaccgttggtacttgaggtacttttattgtttattatttatttatttgcaatcagtttggtaattaagaaaggtcgggttgcctatttgagctgccgtccggcgtccgctagagatggatactgcatatccgaattatagaataaatttaatattatatatgtatatatatatatataat

SEQ ID NO: 166 - DNA, 1277 bp, Zea Mays
gttttgtgtttgtgtggcttttctggttcgaaagacggattagaccaaggtatcaaatttggcttccgctagctgcccatctcgaaacagcatgaaccggcccgatgacgcgcctcaggaggaagacaaatgaaataccataaatccaggctcagcccgaaattaacccaatagcagcccaaagcaaaaccccagcaggaagcaacgtcgacggcccattaactccaacagtcccaggacccccctgcccatccgacggcgatcacgcctcgcgctcgccaggccttatagtacccctatcctagggtttactcgctcccatccactcccaagtcccaacacccgtcggcgtcgagcagcggcagcggcggcggcgatgacgacgagcctgaagaagaaccggaagaagcgcgggcacgtgtcggcggggcacggccgcatcggcaagcaccggaagcacccgggaggccgcggcaacgccggcggcatgcaccaccaccgcatcctcttcgataagtaccacccgggctacttcggcaaggtgggcatgcgctacttccacaggctccgcaacaagttccactgcccgtcggtcaacgtggagcggctctggtcgatggtgcccgccggcaaggccgcggaggcggccggcgcggaccaggccccgctcgtcgacgtgacgcagttcggctacttcaaggtgctcggcaaggggatgctgccgtccaggcccatcgtcgtcaaggccaagctcatctccaaggtcgccgagaagaagatcaaggctgccggaggcgccgtcctgctgaccgcttaggtccttttgcatcttgtttcaactatctgcgctaagaaatattctatctttttttgggtggatctatgagaccctggttttgagcacttggtaacgaatatgagttcgattatatcgatgctgcacacctcttgctgcatgtattattcattctatgcagttgcagttcatgtgggctgtgctactgagatatgaaatgttttggcatttttctgatacgtctaattgtggccttgtggtcaggcattgccctccttttttctggtgtattgttgcaaaacaacaaaatcaattgatttcagtcttgcccactaattttctggcgtatggctgcaaaacaacaaaatcaattgaaagttgtcgtctattttatctttttatgctatgctcctaagaaaatcaattgctggacaaccatgtgttgacaccagcgacggtagatacaaaaataacgagaaac

SEQ ID NO: 167 - DNA, 1765 bp, Zea Mays
ccgtccgatccctgctactccgcagcgctaaaagctgcagctgcaggtcagcaaccagttggagccaaaacaatggtcgaggccgccggagcggaggccacgagacgagaccggggacgatcgatagcaggccacctccatctggccgttgcctttccaacacatcggtttcccttccagaaccttcccaccctcccattccaaaaccatcgaatccgcgccgtccattaccaatccgcgggcccaggaaacccgcaggcgccgctcttacccccttcccaagccacaccgttcccccgccgccaccaggtcccaccaagcgcggcccccgcgtgtcaggcgcacaaacagccacacaccgcccgtgtggctgcgtccggctgtctgtctataaagaaaaacagaccgtccattcgatcgcctcacccgaagcacatcccgtcgcatcccatcccactaccacccatctcgtcgtccgccgattcgatccggttcttccaacccagggtgagtctccggatccgtcgccgtctggtctccgtgtgctctcatcgccgtcgccgccgtctgactgaccccctcgcctcccgcggcgtcgggtctctggtgctgctgctgctgctgcgtgcagggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaagcctcttgttccacgcttgtctgagctccttggagttgaagtcgtgatggccaatgattgcattggtgaggaagtcgagaagttggctgccgctttgccagaaggtggagttctgctcctagagaatgttagattctacaaggaggaagagaagaacgaacctgagtttgctaagaagcttgcatctgttgctgacctttatgtcaatgatgcttttggcacggcacacagagctcatgcttcaaccgaaggagttaccaagtatttgaagcctgctgttgctggcttcctcatgcagaaggtaataaaatgtcacccatgctcatgatcttttaagtatatttaggtactgttcagtaggatggggtaaatattttctacctttcaaaagagaccaataaatctttttaacatttcagttttttcataaataaaaaaggaaagatttgacaaatgactttattatctcaggaacttgactaccttgttggagctgttgccaacccaaagaagccatttgccgccattgttggtggatccaaggtctcaactaagattggtgtcattgagtcgttgctggcgaaggtcgatatcctcatccttggtggtggtatgatctacacattttacaaggcacagggatattctgttggaaaatctctcgtggaagaggataaactcgagctcgcaacttctcttattgagaaggcgaaggcaaagggggtttctcttttgcttcccactgatattgtagtagcggacaagtttgcagccgatgctgagagcaaggtttgtttatttacacataaacacctcagatggcacttcagaattatttctttctttccctttaatgaatcgtgaaagctattcactagtaattctgccgcataa

SEQ ID NO: 168 - DNA, 1814 bp, Zea Mays
ccgtccgatccctgctactccgcagcgctaaaagctgcagctgcaggtcagcaaccagttggagccaaaacaatggtcgaggccgccggagcggaggccacgagacgagaccggggacgatcgatagcaggccacctccatctggccgttgcctttccaacacatcggtttcccttccagaaccttcccaccctcccattccaaaaccatcgaatccgcgccgtccattaccaatccgcgggcccaggaaacccgcaggcgccgctcttacccccttcccaagccacaccgttcccccgccgccaccaggtcccaccaagcgcggcccccgcgtgtcaggcgcacaaacagccacacaccgcccgtgtggctgcgtccggctgtctgtctataaagaaaaacagaccgtccattcgatcgcctcacccgaagcacatcccgtcgcatcccatcccactaccacccatctcgtcgtccgccgattcgatccggttcttccaacccagggtgagtctccggatccgtcgccgtctggtctcccgggtctctggtgctgctgctgctgctgcgtgcagggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaagcctcttgttccacgcttgtctgagctccttggagttgaagtcgtgatggccaatgattgcattggtgaggaagtcgagaagttggctgccgctttgccagaaggtggagttctgctcctagagaatgttagattctacaaggaggaagagaagaacgaacctgagtttgctaagaagcttgcatctgttgctgacctttatgtcaatgatgcttttggcacggcacacagagctcatgcttcaaccgaaggagttaccaagtatttgaagcctgctgttgctggcttcctcatgcagaaggaacttgactaccttgttggagctgttgccaacccaaagaagccatttgccgccattgttggtggatccaaggtctcaactaagattggtgtcattgagtcgttgctggcgaaggtcgatatcctcatccttggtggtggtatgatctacacattttacaaggcacagggatattctgttggaaaatctctcgtggaagaggataaactcgagctcgcaacttctcttattgagaaggcgaaggcaaagggggtttctcttttgcttcccactgatattgtagtagcggacaagtttgcagccgatgctgagagcaagattgtccctgccactgctatccctgatgactggatgggtcttgatgttggccctgatgccaccaaaacattcgacgaagcattggacaccaccaagactgttatttggaacggccccatgggagtgtttgagttccagaagtttgcagctggcaccgaggcgattgccaagaagctagctgagcttacaaccacgaagggtgtcactaccatcatcggcggtggcgactctgtcgctgctgtcgagaaggctgggctggccgacaagatgagccacatttcgaccggcggcggtgcgagcttggaactcttggaaggcaagactctacctggtgtccttgccctcgatgacgcctagatccgctgctgctgctgctactc

SEQ ID NO: 169 - DNA, 1714 bp, Zea Mays
cgtccggctgtctgtctataaagaaaaacagaccgtccattcgatcgcctcacccgaagcacatcccgtcgcatcccatcccactaccacccatctcgtcgtccgccgattcgatccggttcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaagcctcttgttccacgcttgtctgagctccttggagttgaagtcgtgatggccaatgattgcattggtgaggaagtcgagaagttggctgccgctttgccagaaggtggagttctgctcctagagaatgttagattctacaaggaggaagagaagaacgaacctgagtttgctaagaagcttgcatctgttgctgacctttatgtcaatgatgcttttggcacggcacacagagctcatgcttcaaccgaaggagttaccaagtatttgaagcctgctgttgctggcttcctcatgcagaaggaacttgactaccttgttggagctgttgccaacccaaagaagccatttgccgccattgttggtggatccaaggtctcaactaagattggtgtcattgagtcgttgctggcgaaggtcgatatcctcatccttggtggtggtatgatctacacattttacaaggcacagggatattctgttggaaaatctctcgtggaagaggataaactcgagctcgcaacttctcttattgagaaggcgaaggcaaagggggtttctcttttgcttcccactgatattgtagtagcggacaagtttgcagccgatgctgagagcaagattgtccctgccactgctatccctgatgactggatgggtcttgatgttggccctgatgccaccaaaacattcgacgaagcattggacaccaccaagactgttatttggaacggccccatgggagtgtttgagttccagaagtttgcagctggcaccgaggcgattgccaagaagctagctgagcttacaaccacgaagggtgtcactaccatcatcggcggtggcgactctgtcgctgctgtcgagaaggctgggctggccgacaagatgagccacatttcgaccggcggcggtgcgagcttggaactcttggaaggcaagactctacctggtgtccttgccctcgatgacgcctagatccgctgctgctgctgctactcaggttctgccagctttgcgtgtcatcttgtttcggaccttggtgtagcactgcaaggctaaggtttactcctccacacatggactttcgaggataggcttgccaccgtgttttgctagatgagtcgtgaaataagcttttacttcctcgctgctgtgggtgaagtgactggaattcggaaatttggaactaacaaaaccccccgtggatttgtatgatacgttttgttcgacagtttgcgtcccatctttcactgtggtatctggtatggtatgttcttattttttgtctgacagagtgacagtttgcattcctgtgttgccgttgctattcgttcctgct

SEQ ID NO: 170 - DNA, 1677 bp, Zea Mays
ccgtccattcgatcgcctcacccgaagcacatcccgtcgcatcccatcccactaccacccatctcgtcgtccgccgattcgatccggttcttccaacccaggtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaagcctcttgttccacgcttgtctgagctccttggagttgaagtcgtgatggccaatgattgcattggtgaggaagtcgagaagttggctgccgctttgccagaaggtggagttctgctcctagagaatgttagattctacaaggaggaagagaagaacgaacctgagtttgctaagaagcttgcatctgttgctgacctttatgtcaatgatgcttttggcacggcacacagagctcatgcttcaaccgaaggagttaccaagtatttgaagcctgctgttgctggcttcctcatgcagaaggaacttgactaccttgttggagctgttgccaacccaaagaagccatttgccgccattgttggtggatccaaggtctcaactaagattggtgtcattgagtcgttgctggcgaaggtcgatatcctcatccttggtggtggtatgatctacacattttacaaggcacagggatattctgttggaaaatctctcgtggaagaggataaactcgagctcgcaacttctcttattgagaaggcgaaggcaaagggggtttctcttttgcttcccactgatattgtagtagcggacaagtttgcagccgatgctgagagcaagattgtccctgccactgctatccctgatgactggatgggtcttgatgttggccctgatgccaccaaaacattcgacgaagcattggacaccaccaagactgttatttggaacggccccatgggagtgtttgagttccagaagtttgcagctggcaccgaggcgattgccaagaagctagctgagcttacaaccacgaagggtgtcactaccatcatcggcggtggcgactctgtcgctgctgtcgagaaggctgggctggccgacaagatgagccacatttcgaccggcggcggtgcgagcttggaactcttggaaggcaagactctacctggtgtccttgccctcgatgacgcctagatccgctgctgctgctgctactcaggttctgccagctttgcgtgtcatcttgtttcggaccttggtgtagcactgcaaggctaaggtttactcctccacacatggactttcgaggataggcttgccaccgtgttttgctagatgagtcgtgaaataagcttttacttcctcgctgctgtgggtgaagtgactggaattcggaaatttggaactaacaaaaccccccgtggatttgtatgatacgttttgttcgacagtttgcgtcccatctttcactgtggtatctggtatggtatgttcttattttttgtctgacagagtgacagtttgcattcctgtgttgccgttgctattcgttcctgct

SEQ ID NO: 171 - DNA, 1985 bp, Zea Mays
ccgtccattcgatcgcctcacccgaagcacatcccgtcgcatcccatcccactaccacccatctcgtcgtccgccgattcgatccggttcttccaacccagggtgagtctccggatccgtcgccgtctggtctccgtgtgctctcatcgccgtcgccgccgtctgactgaccccctcgcctcccgcggcgtcgggtctctggtgctgctgctgctgctgcgtgcagggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaagcctcttgttccacgcttgtctgagctccttggagttgaagtcgtgatggccaatgattgcattggtgaggaagtcgagaagttggctgccgctttgccagaaggtggagttctgctcctagagaatgttagattctacaaggaggaagagaagaacgaacctgagtttgctaagaagcttgcatctgttgctgacctttatgtcaatgatgcttttggcacggcacacagagctcatgcttcaaccgaaggagttaccaagtatttgaagcctgctgttgctggcttcctcatgcagaaggaacttgactaccttgttggagctgttgccaacccaaagaagccatttgccgccattgttggtggatccaaggtctcaactaagattggtgtcattgagtcgttgctggcgaaggtcgatatcctcatccttggtggtggtatgatctacacattttacaaggcacagggatattctgttggaaaatctctcgtggaagaggataaactcgagctcgcaacttctcttattgagaaggcgaaggcaaagggggtttctcttttgcttcccactgatattgtagtagcggacaagtttgcagccgatgctgagagcaagattgtccctgccactgctatccctgatgactggatgggtcttgatgttggccctgatgccaccaaaacattcgacgaagcattggacaccaccaagactgttatttggaacggccccatgggagtgtttgagttccagaagtttgcagctggcaccgaggcgattgccaagaagctagctgagcttacaaccacgaagggtgtcactaccatcatcggcggtggcgactctgtcgctgctgtcgagaaggctgggctggccgacaagatgagccacatttcgaccggcggcggtgcgagcttggaactcttggaaggcaagactctacctggtgtccttgccctcgatgacgcctagatccgctgctgctgctgctactcaggttctgccagctttgcgtgtcatcttgtttcggaccttggtgtagcactgcaaggctaaggtttactcctccacacatggactttcgaggataggcttgccaccgtgttttgctagatgagtcgtgaaataagcttttacttcctcgctgctgtgggtgaagtgactggaattcggaaatttggaactaacaaaaccccccgtggatttgtatgatacgttttgttcgacagtttgcgtcccatctttcactgtggtatctggtatggtatgttcttattttttgtctgacagagtgacagtttgcattcctgtgttgccgttgctattcgttcctgctacctgtggcgccagatgaattgggaacaaggttttctagtttagttggttaaattatcttctttcagtgttgttctggagtggtggtagctaatggcggcccttgcaaataaaaacttgctacccgagtttggcgctggcgcagcaatttattcattcattttatggcccgtttggatc

SEQ ID NO: 172 - DNA, 2318 bp, Zea Mays
aaaccacagcactggatagaacacgccaaaagcaagagatatttcagtttcgctcttgtctcagctcagctcagctcctgccagtcgcaactcgcgtcctctccaaaaaaacagcccacagttgaagcgaaaacacgaaagctcagtgatatttctctccaggtctgcacactcgtctcctatcgagactgtcggcggccatcgtcgcccacgctgtgctcatgctaagtgtcgaggctcacacgtactactactacccgaccgcgaggccgagacggaagctatgcgcctgcagaaacgtcttgcaagaaaccgccccgcgtgacgcggaggcagatccctgccgccacggcgagaggaagagcaggagaaggggcgacggtgcttattacatcgacaaggacggcggcggcgtagccaggaccttcgaccggaagaaaatatccagaaagagggggggtgctatcaaagggcgtggatggaagtacggctccgggttcgtcgacggagtgttcccagtgctgagtccgatggcgcaggatgtgctagaactcgtgcagacgagggggaccgacgccgccagcgtctgggagtcactggacaagatccctcaagcacacgatctttgggacgacatcgtcaacgtcgccgtccagctccgcctgaaccggcaatgggagccgatcatcacagtctgcgagtgggtcctgcgccggagctcgttccgccccgacatcatctgctacaacctgctcatcgacgcgtacggccagaagcgtcagctgagcgaggcggaggcggcctacatggcgcttctggaggctcgctgcgtgcctacggaggacacctacgctctgctgctgcgcgcgtactgcggctccgggcagctgcaccgagccgagggcgtgatttcggagatgcagaggaacgggatccctcccactgcgactgtgtacaacgcgtacctggacggtctgctgaaagcgaggtgttcggagaaggcggttgaagtgtaccagaggatgaagaaggagcgctgcagaactaacaccgagacctacaccctgatgatcaacgtgtatgggaaagcaaatcagccgatgtcgtcgttgagagtgttcagggagatgaaatcggtcgggtgcaagcccaacatctgcacctacacggcgctggtgaacgcgttcgcgcgggaaggcctgtgcgagaaggcagaggaggtgttcgaggagatgcagcaggctgggcacgaacctgacgtgtacgcctacaatgctctgatggaagcttacagccgcgcagggctgccgcaaggggcgtcggagatcttctctttgatggaacacatggggtgcgagcctgatagagcctcttacaacatactggtggatgctttcggacgagctggtcttcaccaagaggcggaagcagcgttccaagagctgaagcagcagggcatgcggccgacgatgaagtcgcacatgctgctcctgtcggcgcacgccaggtccggcaacgtggcgaggtgcgaggaggtgatggcgcagctgcacaagtccgggctgcgcccggacaccttcgcgctcaacgccatgctcaacgcgtacggccgggccgggcggctggacgacatggagcggctcttcgcggccatggagcgcggcgacggcgcgatcgccggcgccccggacaccagcacgtacaacgtgatggtgaacgcgtacgggcgcgcggggtacctggaccggatggaggcggcgttccgctccctggcggcgcggggcctcgccgccgacgtggtgacgtggacgtcccgcatcggcgcgtacgccaggaagaaggagtacgggcagtgcctgcgggtcttcgaggagatggtggacgccgggtgctacccggacgccggcaccgccaaggtgctgctcgccgcgtgctccgacgagcgccaggtggagcaggtcaaggccattgtcaggtccatgcacaaggacgccaagacgctcttcgcattgtgaaatccgcgcaggctaaattccgatcctgctgcgtgatcacatacgaaccttgacgagagtcacctagcttgcatactggttaacaagtcacaaggccccgtttggttacatatagaataatctactttttagtcccgtttagtacttaattgtatttagtctctagcccttcactgtaagggcctcacatcacatgggtgctaaaggggacgaaaggacatcatttactctaattaccattgcatagagaatatgcaccgtatacatgcaataaaaagagaggcatttcagtctgtgtacttc

SEQ ID NO: 173 - DNA, 1452 bp, Zea Mays
attcctactgttagttttgtgaattcggaggcgcagcgccaccaacttgcaccattttggcaaccccgcagggacaaaagaaaggcgaaacgaggccaccagctcaccgccgagcggaagcggcgccgagcaaccaacccctctcctcgtccgccgccgtctccccggaccatggccatggccgccgcctcctcccggctgttctgggcgtcccgcgccgccgcctacctcaggatctccaccttccccagggccttcgccaccgtgctgaaggatctgaagtatgctgacactcatgaatgggtgaaagttgagggtgattcagcaaccgtggggattactgaccatgcccaggttaacacgctcacatatttctattgctgtgagtttagagtgtgaggcaatactaggtgttagtgttaggccctccatatgtttaggttgtctggtgctgtagttcttatcaacactgatatgcatactgcatccaatctgttgccaagacatcaagttctaatatattatatcatgttcagtatacatatgttagtgaaagacagacctagtgtagtggtgagagctgtcttactgactcaccagtcgcgggtttcaagtggcctctctgcatttgtggaggaggttgcctcctccagcactaggtctcctcttttcagtatacatatgtgaggcttgcctcggtttatcacttccctagactccactcatgtgggagccctcgtcactaggtttgtccagtatataacattagggtttgcattgcttaaaatttgtttattgcttttggcgtccaggatcatttgggtgatgttgtttttgtggagctaccagaagttggcatcagtgtatcccagggaaagaactttggtgctgttgagagtgtgaaggcaaccagcgatatcaattcaccagtgtctggagaggtggttgaagtgaacgagaaactaagtgaggagcctggattggtaagtgttgcaactaatattagccagaactcatctgaaaataaaattctgtgggtagattagtcgatgattatcatttctgattaggttaatgcaagtccatatgagaagggatggattatcaaggtcaagctcagcaattcaggtgacctcaattcgctcatggatgatgataagtactcgaaattctgtgaagaagaagacaaccattgaagaaatcagagtgtcttctaaacaccaggacctgtttttcaagctttatcactggttatggtctggagaccagctgtgacaaattggcaaggttcatcgcaaggaataaatgttaggatttgccaatcctacaagggcatgggaaatccaagtttgtgttgtcaatgacgtggtcatatttgatatttctttgtagttgtaatctcgtgaattccttcttttttcttaaaaaaagtactctttttgattccttcct

SEQ ID NO: 174 - DNA, 959 bp, Zea Mays
attcctactgttagttttgtgaattcggaggcgcagcgccaccaacttgcaccattttggcaaccccgcagggacaaaagaaaggcgaaacgaggccaccagctcaccgccgagcggaagcggcgccgagcaaccaacccctctcctcgtccgccgccgtctccccggaccatggccatggccgccgcctcctcccggctgttctgggcgtcccgcgccgccgcctacctcaggatctccaccttccccagggccttcgccaccgtgctgaaggatctgaagtatgctgacactcatgaatgggtgaaagttgagggtgattcagcaaccgtggggattactgaccatgcccaggatcatttgggtgatgttgtttttgtggagctaccagaagttggcatcagtgtatcccagggaaagaactttggtgctgttgagagtgtgaaggcaaccagcgatatcaattcaccagtgtctggagaggtggttgaagtgaacgagaaactaagtgaggagcctggattggttaatgcaagtccatatgagaagggatggattatcaaggtcaagctcagcaattcaggtgacctcaattcgctcatggatgatgataagtactcgaaattctgtgaagaagaagacaaccattgaagaaatcagagtgtcttctaaacaccaggacctgtttttcaagctttatcactggttatggtctggagaccagctgtgacaaattggcaaggttcatcgcaaggaataaatgttaggatttgccaatcctacaagggcatgggaaatccaagtttgtgttgtcaatgacgtggtcatatttgatatttctttgtagttgtaatctcgtgaattccttcttttttcttaaaaaaagtactctttttgattccttcctatgcaaatttcttggtgctttcgcgaatggttcagattcttcagcattgtta

SEQ ID NO: 175 - DNA, 814 bp, Zea Mays
aacacgaggctcccggactcctcagttccttcgctcctctgtaacccggggcggccgacgaggccgggaccaccgacggcgacgatgggcggcggcgagggcaagtccaagaaacgccgctcttctacctcctcagcggatgaagaagggggggaacggaagaggcgggacaagaaggagagcaagaggaggagccgagacgacagggaggatgacgatgacagacacaagaagaaggggaaacacatcgacaggaacaaaggaaaagagagagattcgaaggataggcattccaaggagaagacgagcaagagaaaagacaaggacgctgccttcaaagaaatatccaaggatgactactttgcaaagaacaacgagttcgctacctggttgaaggaggaaaagggcaaatatttctcagatttgtcttcagagtctgctcgtgatcttttcttgaagtttgtgaaacaatggaacaaaggcaagctgccatcacaatactatgaggggattacgagtggcccacgatcagcgcacaattggaacatcaaagcatgatacgttttctggttaatcgggtccttcggcttgagatgttttttgctttcctggcgagatttttctaatagttgcatctagcaactgcttttaatattctgggttgttgtatttaagctgatgttcagaatgtctgtctaagcaggagggtagatcgtgggtctctctagtatccagtgtttaacatcaacgctacttttccattgatcactactgtttgatcctacaatgagcaaacatattgtttctaaggaaa

SEQ ID NO: 176 - DNA, 621 bp, Zea Mays; identical to SEQ ID NO: 1

SEQ ID NO: 177 - DNA, 1755 bp, Zea Mays; identical to SEQ ID NO: 2

SEQ ID NO: 178 - DNA, 1887 bp, Zea Mays
gccgccgctgcacactgttcatcttcctcaaaccgccactccctcacgtcttgcgcgcagccgccgcaccacatcctcgcctcgcggcatctcgcctcaccttgctgcatctcgcgctcgcctcgccctctctgcgctcgtcgtcctgcagagaagccccacgtgcatgtcctctggccgagctcccagcaccctccgcaaaagccccatggaggcgtgcgattagagccctcgcccatcccctacgtgttgctgtgcccggacgccgccgcagccgcgtagccatggccgtcgtcatgccctgcgcacacgtcacttccgccatacgcccactgctccgacgatcttgttggcatgtgtggtcgctacatctcgcgttgccaaggtaaggccatgctatgctatttcccctctccttctctattgccgcgatgccacgctgccgtgccatgagcaccaccgacccaccatggccactgcacgccctggccggcgagcggccacgcccgctccgaccggtgggctccttccccttgcagctcgtccatggaagaactgtcgggggccgctaccctgctccactggccgcatcaccgtcgcctggccatggccgccgacaccgacgtggtccatctcctggccagcaactaactcgcttgaatgccccgtggtggtagggagagaaaaatcaaccgtacacgtcatgcatgggaaaaaggcatgcaagtagaaatgaccgtgagccccacgttgcatgtcgtattcctctcctgcctgcatgagatcaagggaaacagtcctccaaggatccgaggtggatgcaaaatccatgaccatccctgggatttggctcggaccaatcacaacgcaccatatcactttaaatttgcagtttattaaatacatgttagagtttatgttataaatccattttatattgttcagattgcgttagcttcgtaataatgtcgtgcacacgttaaaaatattgttttgtcaagatccatgttttatttatttagttaattgttagttcgttcgttggttattaaaaataactgttagttaaaaataacttatcgttttaagctccccttttattaatacatgttaatgtgattatgccaattcaaatgtttttaatttattcttgcttagtataaacacgaaattagttagtcattcgcgtgtgtcgcgcgcgtcgtcgcgtgtcgtccgcgcgtgttgttcgcccgcgttgtcgcgcgtcgttcgcgtgtgtcacacgcctcgccgcgtgcgagattaaaccatttgtttataattactcatgtgaattaattagttacttatttgatcatcaactattaaaagggtaagttagactagaactaagtagcagtgttagtttacatttaattaatatcaattaatatagagatatcggattaaatattccatttaatacttgcttagcgtaaacccgttgacttctcgaccatagctccaactatcgcgtttctttgtcctcgtgtgaccatagtagcacactctattttattttgcgtattttactatgctttacttgaatgatgtaatgttcctatgcatatatatggttgtttgtttgttcctgtttgtattcgctgtgcgtcgcgaatagactgcgatccaactccgaacttcgaggaatcgacgatcaagcttcggcgaccaaatgacccagctcttcgagttccacgaagttaaagaccctgagcatctgtttggtgaaggcaagtgtcctctgacctattatgtcccatttactttataattcatcaacccgcataccatgatcaacctaaggattgactagctttctattcacgtggtccttgattaccttttgggctactatggttagat

SEQ ID NO: 179 - DNA, 255 bp, Zea Mays
gcactagtcgctactagctagatagccatatcaccagcatgtggaggctgacggtggccgagggcggcggcccgtggctgcgctcgacgaacggcttcgtggggcgggcggtgtgggagttcgaccctgacctcggtacgccggaggagcgcgacgaggtagagagggtacgccaggagttctccgaccaccgcttccagaggagagagtcggccgacctcctcatgcgcatgcaggtatacactattatgacta

SEQ ID NO: 180 - DNA, 1290 bp, Zea Mays
acggcagcctgtcgctgtcaccgtcgtcatcttcctcctgtgatcgccccgctccgcttctgcaggccacggctgggcgacaccctgatggcgtcgcctcctcccgtggcgaccgcggggcctcacagcgtcttcgtgtacggcacgctgatggaagaggaggtggtgcgtgtgctcctgggccgcgccccgccctcctcctcccccgcgctcctccccgaccaccgcaggttcagcctcaggggccgcgtctacccggccatcctccccgcccgcgcccacgcggtgagcggaaaggtccgcgtccgcctctcgctctcttcatgccagccgtaacccgtctgggcgaaagacgccgagacagcgctcccgtttgaatccgttgcccctgctccgtccaggttatccaggggctcaccgacagggaactccatgtgttcgacatgttcgaggacgaggagtatgtgaagacaaccgtcgaggtctcactgactgtgagtccactgcaaccctatctacaccatcgtcgactgcccatgctttacctcgcattattgttccgaacttctgaaccttagtactccctccgtaatgaaaagttatggaatccgtacgcgtcaaactagctcaattttgatcagatttacaataaatagtatttattaacttgtatgtctccagatagatttacgacgattctgtcactaatctaatgatacttattttgtgtcatgatttatatcatggacgttactatatttttatatgaatttagtcgaagttcaaacggttcgaaaaaacgagaatcgcactcttttattgatggaacggttccattctcgccgatcaaaacggttgttctggggtttcgcaggatgcatcggagaaatcactcgcctacgcctacatatggggtaaccagggtgatcctgacctctacggggaatgggattttgaggtctgactgaatgccatcgtatgatgctcgtgtttctgtccgtatgttgcttcgatttgtattgatgtctcggcttctggtctttaggagtggaggaaggtgcatttgaagtactaccttgagatgactcgggaattcatgctggaactcgggcaattttaaacacttctctggtttgtaactacacaggagtcagaggatccttgcaaaactaccatagaataatttgtgtcttgtgctcgacgagttcttgctactatgctgctttgggaacatacacatgttatttgagccatttagtcatttggatgtgaacaaatcgattcttctct

SEQ ID NO: 181 - DNA, 8051 bp, Zea Mays
acggcccttggtcttcgtgagctgctgctcgcgttgtcggggaggcgccgccacgccgctcgcctcgcctagcgccgcgtccggattccggagcaacaactcctaggcaggtagtagtagtagcctagtaggttgtgaacgacccggccggccggcggcgcggtgcagcgtccccgctgctccatgcccgagggccaccagtgaagctcccgcgtggccacgcgacgcgaccatgaagcagtccccggccagctctggtgtcacggccgcgcccgtcgtccctgcccccgcgcccgcggccgcctccaccggcgcggcgccgccatgcgaaggtacctcttctaccaccaccttcctcctgtttgcgcttgcggcgtgcgcatgacgccggcctcgacggaacgccgcgcccgtctgtcgccggcgcggcgggcggcagttcgcgtgttcgttcgagctgcgtatcatccgtcccaagctcagaaaggcgtcgccttttcatgtgttgggtttgttgttgttgtgtcgctgacgccaacgccggcgtcgccgtgcgcccgcaggggagcggaaggcgccggcgatcaacgccgacctgtggtacgcctgcgcgggcccgctcgtgtctctgccgccggtgggcagcctcgtcgtctacttcccgcagggccacagcgagcaggtgagtgacaccgcgctctccctcctcgtccccgtgctgctcatgcttctccaggcaacggtcgctgctgacgccattgctgcagccattgggatgctctgttgttttaataggctgtaacatccgctgatggatgctttggtcatcttctttgggatcatgtgaccacatcttcaattggtggttaccgatatgtcggtgttctctgttatctgtgcagagtttgtggtttcattgcgatttcaggtggaaagttgtgtttttttccttctactgttcattctgtgagtttttgcttcgtgtcgagttgattttactaaaatgtttttattttataaaggaaaagggatatggatatatgatataaagggtactacaactataagtgcaggaatagtttaaaaaacagttttttgatttgttgtggagcctactgtttgttgcagaactaattggaatagcccccgcacccccacccccacggccccatccgaaacaatctgctttataaccagatttctggtgattttttcttttccattcagatatttttggcacaagaagattcccatccttcactagaaatgtgaagatttcactcggttgctgataccctcgggtgcaagaacctgctaatgttagctcatttgccaaagtggttggaactataggggccctacttgcttctttcctctgttggtttctggtgtgctgtgtggacaacttccttgtgaggagtttgggggtgtacatgaagcatcttctctgcatgtgggctgcttgcatttatggtcctgggatgtgtaattatttgtcccaggttcctaagatttgtcactgtaaaataacatgatcatgaaacatttttctttatcacaagtcatggtgctccattaaaaaaaatcttaatccaaaagccagccaccgtgttcttttcagaaagataagaacataaattacctttctatttcatttcatcagtattaaaaaaaatgaaggaaatggagtccttttgttttccatgacacatctggttgtgctgcgcatgatggtagagggctttgtgacagtacttgtaaagagtttatctaacaaaaaagttcactcatgcggcgctccttttaaaccgcagactactttccgcttcaatttttttagtcaaaccgcagaaagggttagcgaaaggggaagcatgttcgaatggctctactttcttaatcatttcatggaatgatctcttttttccccgcaaaatccgcagagtactgatgagtctcggcactagcacgtctttcatttcatgaaatagtaacaacaacaccaagataaatattttttccccgtgcattattctgactgtcacagtaatgcggcaatgaacatacaggacaggttttgtggtataatactggaaaataatgagagaaaaaaatacaagatccgatatacttggtgcctgcaatttaatgtattccgagattaagacaaaacatttgaatgctaatatatatatatatatatatatatatatatatatatatatatatttcacttccatccaaacggaattgtgtatggtggttggacttaccgtgctgctgattcaggttgcagcttctatgcaaaaggacatcgatgcacatgtgccaagctacccaaatcttccctcaaagctgatatgtcttcttcacagtgttactttgcacgtaatgcacacagctcctaccatgtccccttttgacacggagcttgcatcatcgcccattgtaaaaccgttcctctttttgtcctcaggctgacccggatactgacgaggtgtacgcgcagatgactcttcagccagtgaacacggtgagcatctagaactggtggttccccccaaaaggctgttgcttgttcagacgtcctaaaaccatgtctttggctctgggttcagtatgggaaagaggctttacagctatcggagcttgcactgaaacatgcaaggccacagatggagttcttctgcaagacgcttactgcaagtgatacgagtacacatggaggcttctctgtgcctcgtcgtgctgcggagaagatattacctccactggtatccagtccaggcatcgaatacctaatattgcctgccagaacaagatgctctctgtccatcaacttcgtagtgccattttaatgttttttttttgtgctctcctggtctgcccctataggacttcggtatgcagcctccggctcaagaacttcaagccagggacatacatgacaatgtgtggacatttcgccatatatttcgaggtggggaaaagaaagtatatcactttcattgctacaagatggcagtagcagtaggacttcttcagtttttgtatgcaagcatcccccccccccccccaatatggtttcaagcatttgaagaaccttgcacatcattcttttatgttctgggtggtctgcaagggaaagttgctgttactgttgccgaccttatgaatcattctatgaccaggtcagccgaaaagacacttactaaccactgggtggagtctttttgtgggcggcaagagactatttgctggtgattctgtcatttttgttaggtaactttcatgatttttttcctcttgcaaaagcttgtcttgatcctttctagagtaaagattcttaccaacttacctgtgaaacaatgaacaaaactggagtttaaatatcatctatgttttggctcatcatgtttttagggacgaaaggcagcaacttctactgggaatcagacgggctagccggcaacccactaatatatcttcttcagtactttcaagtgacagtatgcacataggggtgcttgctgcagcagcccatgctgctgccaacaatagcccatttaccatattttacaatcctaggcgagtgattttcctacactatattttttcccaccctgatggctctaaacagcctttttatgtagctcagtagctattaatgatctatttgaaatgtgcactttcagggctagccctactgagtttgttatcccatttgccaaattccagaaggcactgtatagtaaccaaatatctttaggaatgcgattccggatgatgtttgagaccgaggaattagggatgagaaggtacaattgctctttttgtctattttaatttggcacattattggcaaacaatcaatttatgtttacttttctaaatcctaaattataggcatggttttgttgcctattctacactaatcaaattattcaatgttcttcaggtacatgggtacaataactgggataactgatctagatcctgtaagatggaaaaactcccagtggcgcaacttacaggttagattgcctgaaccacaccattgatgacggatttggtttgcatctgattcacagatgtagtgtaattttgtaggttggttgggatgaatctgccgcaggggaaaggagaaacagagtttcaatgtgggagattgaaccaattgctgctcctttcttcatatgcccccagcctttctttggcgtaaagcgccctaggcaaataggtaaatcagccataagttcatctttctgtgttatattgcaacgcaaattgcatacaacgacagccattctgatggtttacatggttcactcatttgaattaacagatgacgagtcatcagagatggaaaaccttttcaagagggcaatgccttggcttggtgaggagatatgcataaaggacgctcagacccataacaccacaatgcctggtttgagcttggttcaatggatgaacatgaacaggccgcagagctccacattaaatacaggcatacagtcagagtatctgcgatctctaagtaaccctgccatgcaaaaccttggtgcggctgagctcgcaaggcagctatatgtccagaaccatctcctgcaacaaaacagtgtacagcttaatgcttccaagctccctcagcaagtgcaacctataaatgagcttgctaagggatcattgtcttgtaatcaacttgacgtcatcatcaatcaacaagaactgaagcaagaagttggcaatcagcagaggcaacagcagcccgttaaccaagcaattcctttaagtcaggctcaaaccaatcttgtccaggcccaggtaattatccagaatcagatgcaacagcagcagcaacaacagcagcagtctccaactaggtgccagaagggaaccagtgtgcaacagctgcttctttcacagcaacagcaggaccagaattttcagctgcagcaacaacagcagcttttacttcagcaactgcagcagcagaatcagcagcagcagcaacaacagcagaatcagcagcagctaaacaagttgccagctcaacttgtgaatctggctggtcaacaggctcagttgtctgaccaggaacttcagctgcagctattacagaaactacagcagcagtcacttgtatcacagccaacagttacactctcgccgttacaggtaatacaggaacaacagaagttacttttggacatgcagcagctatcaagctctcattcacttgcccagcagcggatcctgcctcaacaagatagcgatgtttcgctgcaagcatcacaggcgccaccaccaatgaagcaagaacagcagaagccttcacagaaacaatttgtgcttgcagatgtgtcagatgttgtctatccacagatttcatcaaccaacgttttgtccaaagctggaacccaactgatgactccaggtgctacacaatctgtactaacggaggaaattccttcttgctcaacatcaccttctacagccaccggaaatcatttggcatacccaatcattggcaggaacgagcattgcaaggtcaccattgagaaagttcctcaatcgtcttctctgatgtcaattccaacagctggtgaagctgtaacaactccaataatggcgaaggaattgtcaaagttgaaccataatctgaaggagaatgtaaccacatcaaagtcacccattgttgggactggacatgagaatcttttgaacattgtaccgtcaacagacaacctggaaacagcttcatcagcaacttctttatggcctacccaaacagatggacttttgcatcaaggttttcctactaacttcaatcaacaacaaatgttcaaagatgcacttccagatgtggaaattcaagaagtggatccgactaacaatgccttctttgggatcaacagtgatggtccattgggctttcctatggaaaccgaaggcttgttggtaagtgcaattaatcctgtgaagtgtcagcctaatttgtcaactgacgttgagatcaattaccgaatacaaaaggatgcccaacaagagatctcaacctccatggtttcacagtcattcggtcagtctgatatagcttttaactcaattgattctgcaatcaacgatggtgtcatgttgaatagaaattcttgcccccctgcacctccgcagagaatgcggacattcacaaaggtttgtgcttctttatataacccaacttactggtattataacattcaacagtataattttgttgttgtatttactaattccagaatattaaattgtggggttttaatggaagaatggaatgcacttctgttcactgctggacaccaaatataacatgaattaatggagcagatatgacaatatatgtcaagtacaagtaaaaatttcaaatgtaaaaaagtttaaggacagggtagtcaaaattctgccatattcgaactagtagaaaagcacatgtataactgtcttttcaagagcacatttatggttttagccgtgttagtatatggtgccatgctattatgccaattgagtagtcagctactgtcaagctgttttgaaatcatgattcaaatgagataggtgtattaaatgcttgcttggatgtatggttgatgaggtggtcacatatagctttaaaagcttgtcaaggactggactcttggtaattgggaccctctatgaccatgcttactctgtagccataaactcttgagcatgtgctttgcttgctatggccatttcattcttttgaatgtggacctaacattttcataaaaagtggccctaacataaatcctgtaggtctacaagcgtggagctgtaggccgatccattgacataggcaggttctccggatatgaagaattgaagcatgctgtggcccgcatgtttggtatagagggccaacttgaggaccgacagagaataggatggaagttagtctacacggatcatgaggatgacgtcctacttcttggtgacgacccatgggagtaagtttaccttcctacttttgctttgtattaatttttgtattttcactatgaaaatctgtcaagaaaataacattataaaggtgccgaatgtagatgtgtacactgtctaggaatgtaatatagtaaaaaaaaagatgtacaaaacgtagactgcaatgtgcctatgtcttcctttgtattgaatattgataagcacatgctggagcttatagggtgtgtaagttttgtaaatgcactaaacatgaatgatagaagaatttcgttggttattatcataataaaatgtgttgtgaattatacagggagtttgtgaattgtgtgaagtgcattaggatcctatccccccaagaagtgcagcagatgagcttagatggtgatttggggaacaatgtcctctccaaccaggcttgcagcagctcagatggtgggaatgcctggaagcctcgccgcgaccagaaccctggtaacccttccatcgggttctacgaccaatttgagtgacctgatcacgggtacgttacacacagttcgagtacagtatttcgtttcatccctgtattagttgttgaactggacttcacaattatgaatccagaaattcgagatgagaattatagctgcaaaaagcaaccagtgtccagccatctacagaattatcgccacggaaagggtaagcagatgcaggatgccgtagacgtcttggcttttatagttgggagaggaaatgctcctcagattagggtatgttctagatatatgtgtagttttctttgttttgaaacaatgtaggcaagaagaatgaaacttacctagagctgttgctgagtcgaaacatcagacagatggttaggcaaaacctgaacttcagacagagtaggcagatctgaagataaagtattttgattgagagtattttgtaattctgtattgaactgccgctggggtttgcttgagacccatgcggcactatatgagtctctctcagttcagaaaatactgaagcagatctaagaggtcctactgattattactata

SEQ ID NO: 182 - DNA, 791 bp, Zea Mays; identical to SEQ ID NO: 7

SEQ ID NO: 183 - DNA, 6780 bp, Zea Mays
gcgtagccgacgacgccgacgacgaggcagccatggccgcccccgccgcccggagaatagttggcgctgaggttcccatacccggctcggacaagctgcggtggatcgacctcaccatcccctcgtcctccgccgctgcgccggcgagcccctccgatcccttcgtctgcgtgcccccgcgtgctgcctcggggtgccacatcatcccttcgggcgattctcagtattacctctcgtggtacgtgttgggggcttctcctcactttcgagctctatattatggctctgttcagatgagtgacacattgtgttagctggacatcgctcaatttagacttagcttcgaatagttttcgccttctgagttgtttgtgctcatgtttatgtgaaatgaatccttttagaactagaacttaagtgcacgcttagtattgctttggtacttgccacatccagagaaaccctaggtccatacctcatagtaggtggagatttttttgaatggagcattggagcatatggtttcttcttacaggaggattcacgaggaacacccaaatgtgctggaggtcattgaacttagtccctccaaggagttccctagctttggactgcgtcttgccttccaggaggcgctatctccattcgcctttctatgtgaacgagaggtttgctcattcatgacaccttacaccaatcgttgttttcacgaactttctggaacattagagactagactactcacttctgtggcaatgcagggtcgcaggcaaggggagcttgtatatatgctatatgtgcttaccgtttctggagttgctcttttgtgccacctacgcagcccattttcctacgtatctggttcagtgctgcatcaggatgatatagctgagtttaatctccaaactcaagctcagagcgcaaaggttacagcggtaacagcgaagccaggatgtattgtgattggtcggcaagatgggtccatctgttcttacagtcttggcaaattagccccaaactcaccaggcgtgttatctactgtctatttgcagcagcaaactcattgttccatggatttagtgggttccagatgattgagtttggggccttcttctgtaactcccccaaggttcctgaatgttattgttttctactgtaggtttctcgaatgaactacgagatgatgctgggattggacgtttatggactctcatgtcaaggtactatcttggattcttggttataatggcacactaagcaatgaaagcatgattagcttagctaactgttgctagaacatctactgttttcatgtttggctattaggcattgcccagctgcatagatattttcagaaactaccatagcataggaagaaggaacagcacatgcagtgttcatatgcttgttgactcaaatgacacttccatttattgctgctattctcatggtagcatatttgtatacgtgaatggatttccagttagttggtctacatctcatgttctgttttttttgcatctttttttcatgaaatctacctacattattttgcagaacaaagactgtgggtcctgtgcaggacatagtagcaactgttgtaaatgaaagggacctgttatttgttcttcatttggatggacacttgcgcatatgggataatcacatgaaacttctcaactataatgtccactcaaatgacattgaaggtaatgtttatgttctctttacttgctgttctcttgatcttgtccttctgccctattgttcattgttatggttctttgtaagcaatgctgctctttttttacaatgcatgcaatgttgttgtgacacatgtaagctacaatctgcatccttaagtcagtcctcgtatcgaatctgcccaagctgctggtatcccatgtctatactattgctggatacaaggttcagctaggcgctaggcggaatctaggcggtgacccattgcctagcgcctagtcgggagtactcggtcttaggcgcttctaggcgcttttctaggcgttttggcaatatagccataaattatatatatattatgtatataactatatatactatatatataactactatatatgactatataactactatatactaccaaccagattttgacctgggaaccccccgtctaaccactgcaccaacatattggaattcgagtgaagagtataacataccattgtgctatcagctgtaaaaacaaagaactcaagcacttccagtcagcatctatataacaaagcacaagcagaggaaagacggggaaagaaacagaagaggagggaaacagagctgcagaggagatgcgaactgcagagcatatccaagtcgagcagagcatatccaagatgagcagggaggggagcagccgacgggggaggagaactcaccggcgggggagcagggaggggagcagccggcgggggagcagccggaggggatgagcgccggagggaatgagcagcgaggcaatttccgtgaccatgtgggagggagaccgagcggcagcacagcgcgcgcgctaatactcccgcgcgctaaaactcccgcgcgcgcgcgctaaaaattgccgcgcgctcgcccgcgcgcccgcccgcgcgctcgcctgcgcgcccgcttaggcgcctgcgcgccgccaactcgccgcctaggcgcggctgcgcgcctcctagtcgctgcggccgcctagacgccgcacagagccctaggctacgcggcagcctggcgattagcgcctaggcgcgcctaatcgccgcctagtcggcgcctagccgaacactggctggatagcatataatttttgtggtgggctgatgatagctttatctgtgcatgcttgtttcagtgagctcagtgacattgcttcaaatgtggaaaaaatacagtgaggatcaactgtaacctacatgcttgtttttttggttgcaatagtgctatctaagagttaatggaagggtctgattgaacaatctgagatgcataagcataaagagtaatggttttcatgaataaacttgtggagctgtgctttgatgcatggcaattttgcggtcgcctctacaatgctgtcccttgtttggaaaccatggtttgacaaaaaaacgagtctaagctttgcttgcacataatcctgttcttgagcagttaataacttaacatctattgacaaattctctgtacctcaggccatccgtccaggctatgggttggtaaggctgatgatgatcaggagttgatatctttggcgattctgcatcaaaacactgtggtatgccaagaatgttgcctcaccagttatttgctcatcttccattcacaaaatctagtatactagtacaagtgtacaacatgggaatatagcctacctatgtttgtagtgataaataactaggtaactccactttcttgaaaacggtaacataatgttctattctaggtgtaaggtgaatctgatgttgtgaagtgtatcaaatgtgcatactatgtgccaagaatatctccaaactaattgcaagctgtgccttgccagtgtttttcttgtcggcagatcacttgatcttaatgtgattgagagtaaagaaaaccttttcgaccatattgagcaaaaggagttggacagattagtgatggcaaatggattagtttctaggttgccttggttagtataatattaagatggattaatgaattggtgacatatattactgtggaacattattgtccttattagacggcgagacttattagctgtgggttatataaccacaacctggcgattatcttatgctaacttcagccggcaataaatgatgttccaacagcagaagcagacttgctgctagtacaaacctctggttagaaacttaaatgttggatctgttgttctactctttgcttgagcttatatttcactttgcgatatctaattttttatctgttgttctactctttgctcgagcttatatttcacttcgtgatatctattttttctattgtgggttgctcgtcgttgtatgatgacataccgtgatggaaaatgtaatcttttctcatcaattattgctgtaaaaagctgattggttaatattgtgatattttaaaggttcaaggttgtgattatgttgctgtatatggcttcggtttttctgctgcggaaaggttcatgttctcttctgaaccttcaatttctactatacctttgctagaggtaaaacaccactgccagtttattgacattcttcaacaaacttcaatttcttttaaaaaatttccatctaattaactaaatgaaaatgaattggataaaagatgatgtagagttatcttaatctttccaatcatagtaactatggtgtatggagtttactttttttaaatatttttatgtatttctgccaaagatactgcgctttatccttatatttttcaaaattacatattgtcttgcaaatatttatgcattttcttggcagataacattgatgcattgttatttcttatatttttaaaataatagcacccctaccctaaagtaaaataaaaataatcccactgtaggaaaatcagaattgctttccttgtgtctgggtattttatttaacctagcacatttgcttcccacagatagctaatatttccaaccttcttactcaggggaagcttgcggacttgaaaatagccacatataagctttggatacttaaagaatttggctccatgctctatgaaatattacagtatgacattgacaccgaaacgtaagtctgttgttcctcattgttgtcattatgttccgttgcaattcttcaaccagtgttagaatggcatttactatgttacttctgttgtccatcaaatggaactatgcagtaagcatctcattaaatgagctatatcagtggatgattacatatctgttagagtacccaccttgtgtaattacctcctcacccctttgtaatgggccaggcccaactatctcagtctattaatacaacacccaaccctgtgttagggtttcccacaatatcaacaactatacaaatgctagctgactaacatatattacagaaatacacacaatccttattttccttttaatatgtatatcatatatattatcaatttcatacacaaaaaaattgtaagcctgcatgcaataacatactgtaactccataaattcttggggaatatttcggcgtgcacatgtgtaacctttagtcagtatttgatttcctttcttatgtaaattacattagctgaattatatctagtaatggtaatggattgggccggttttatttgtagtgcaaaatgttgtagtgagaaggtttgctgttatgtgctacaagaagatgctatcagtgaacagttgtttcaaagttctgacaatgcattggatgatttggtttggacagctgattcaatgttctcctccttgaaggtagctataatttccttatggggttttcatagttgaaatttccatgattttatcatttatgataatgaattatgttcaacttgaatcatgggcctgctgctttgcattgctgttaggtctttgttatatttgcctttaaattgagtgatctgctgatggacttttgattataaaacacttggtcgctggaactccagagattattcagcatacatttgttctcaactgttgaacatatttctttaatttatttattcataattccatagtaatttatacactttgtaattttgtttaatttatgattgttaccaatttgatccttccacttttcttcttgtctcattttatctcataagtttcgaatgaccaattttattatcgacattgaacctgtcttttcaagtgaaaaaatgtcatattattcagacaataatttctacacctgtgcagaatatattgtttagcatttttcagaactcttccatgcattttacctttacctttttttgtgtgcatatttttgtgaccgtagagcactttgatatccttagctttctatacatctttggtatctgtaggaacaggcttttactttgatttcatccatgtttctgcggaggctacttcaaccaggagtaaaccactgttctgccctacgtgaaaccttactagagcataaaaggttcctatcagattctgagttccagtcacttacagcaaatgggctacgaaaagagatattatctattatagaacaagaggtaatctttttttttgttttttgtcctttgttttgttcctttaaggcttctattttctagttttcttgtatggctgaatttccagaattcttttggttttagggaagttcacagacagcaagtgctacagcttatcactggaaacaattctctgcacggtacctccacaattggtgctggcacaataagccctatggattgtttcttgatactacaaatgaagtgtttggtttagtaagaaagggttcattttctctattccgttgtttggagggtctggagatgcttatttatggtgtgattctttcttagtttttttgcaataaatttcacttttctgttgggagcgattaggtaatgctaattagactaacatttcaggttatgaccatggggtgaacttactcgacgatgtgtctgattttgaactcctcaatgaggtcctcagatgcatgggcaatatacaccatttgctggggagatcttccacagcagcatattatgaatccttaattagttctattatatcatctgatgaaat

SEQ ID NO: 184 - DNA, 8235 bp, Zea Mays
atgctgtttgtgttatccagttgtttttctcatcattttatgcaagggatgctcactattagattggagcttaaatttgcctcttacctgtggaaataggttctttgtgacggagagattccattcactggcttggtagagaaagtggagcaagagctcttctggaaggttcactcattttcagcatagtacaatatttgtgtcttgctttccgccacaccgatcttatttttagtttcacaggctgagcgctcagatctgtcgtctagaccaaatctctataaggttctttattcatttgaagcacataggaacaaatggaggaaagcagctgcatacatgtacaggtactttgttagattgaatagagaaggtaatgcaggcggcagccaccaacttcctcacgtgttgcaagagaggttgcatgctttatctgctgctatcaacgcattgcagcttgttgatccctcatttgcatggctcgattctatttgtgaagccgatgataaaatttctccaagtaaaagaccccggaatcttttgatggagaactgtatgttttgtcagacttttaattgctgtttgatttatctcattgcacagcaacacactttgtttaacttttgctctctatttcagcggcttttggcacaaactcagaactttctagattgcaattttgtgttgacattgaaatccttgaaaaagaatacatattaacagaagcacagtatatgctcagcactttgaaatcaagttttgatttttcaggtatccctgaaactattcataggactttattgcttgaatttatagagatcaataccttaattagcaatctttaagaattaacaccgaaatctgtttttgtgtgactgcagaaagccaatctattgagtccctgatggatattcttataaatgagaaattgtatgatatagccttcacaattgtgctaaaattttggaaggagtcagaaataaaaaagtatttcacattttcttgttttgtttccttttttatctgtagcgctgtcttaagggattgctgtttgtcatgttctcttctatgtctacaattcggtctcactgtatctattgtttcaattgttccgttgtaggcaattggaccgtgtattttcagtcattgcgcagcaatgctgctcgaacagatcagacaacaaatcaaggtatgttgaccgactcttctaattgcacatatgggcagattattgtgctggcaaataatagtgttaactaatgatgtgagatgtatcctaattacggaagtttgactgatagtaaacaagtgccacttctgccttcttctgagaatgatgcatgggagatcaacaataggagtattgctgtgacccaacaattgcaggggagcaaccactgggaaacccttgaactatatttggtatgtgccttttctgttttcctcatcatcagtgtgacggtgcgtaagggcctgtttggatctcatgtgataaattttacaaggtgctaatgtttaaccatctcaaatggagagctaaagtttagcacatgggtagtgtttggatgcatatgctaaagtttagcatatggatatagaaaggcatccatacccctaattaatacagggtggggaagagagtgtgggtgagtagggtatgcgatgtcttttctttaccctggaccacttttaactcactttagcacacattggaggagctaaactactaatgggtgctaaagtttagcacttcacttttaacatcttttaacatgggaagaaaaggcaaaacaaaacacttgccttgtagttatttgggtcttcttctttccttgcacaagttatccaggcagcagttccaaccttttattgatagaattgctgaccagctttcaagttggaaggcagacttattgacaaagctgagaaatgtcttctatgtgacaccctgagaaaagaggtctaaaccaccctgagaaatgtcttctatgtgacaaagctgaagaaactctagatcttctggtggcttgctccttctcgagaatcttttggtatcaacttttttggaaattcgggctacactcccttgccccccagccggctgccacctccttcctgtgttggtgggaggaagtttcagatgtggtttcaggtcttaccagaaaaggtcttgactcccttatcatcttgggtgcttggacgatttggaatcatcggaacagatgtgtcttcgatggtttgtctccatgcctcacctctatccttgctttggcagatgaggagagaagtcgttgggaaacagctagggcgaaaggcctatgttctctggctgcctctccagctgctccctagggtggtgtgttggttttttcatatggtgaatacctttttgtatgctatcttctggccgccgtaaggatgccttctgatgtatggtctattttagacctttttattctatcttcttaatatataaaggggtgcaattctcctgcgcgttttcgagaaaaaaaaacacttcccttattaatataacacacagctctcttgcgggtttgagaaaaagaacaccttttaacactcctgtttggatctccaagtgctgaagtttagctaaaagtgtagtgctgaagtttagctaatagtgtagtgctaaactttagcaccatggatccaagcaggcccttatttgagtgtgtctgtgtcagggcccaagagggctgctactgtagcgcggggtaacgtggtgcggagcagaaccggggtactgtagcaccagccatccataacagtcttctttttagtattttctaatttgggaatctctatccctgaagtactgtgttgaactataccctcttctttttgtaaggcttgatttgagtgctgtctccaaagtcatactttgacagttaatatcccatattatgatgttcataactatgagttcgatatcatatgaaaatgttttcaaatatggatccagtaataccaaatctgtgtcatataatttgcaaattcgtagattaagtgtcactaaaaaaacaagttcaaaccttgggttgcgctggagttattttttttggcatttggccagggccagaggcatctccttcctctgctcgtggcccagtgggtgagtcttaggtggatcccttgtacaatctaggttgtttttgttttcccagggtgagatccgttttcgttttctcgccttggggtgtgtgggtgtttgaatttgggcctttgcccccccctcctttttcttaacataatgatgcacagctcttctccatatctgagaaaaatatcttgggttgtgtgtgccccttgtaaaaaagaaaaggagtaagtactttgttactgatctcatgggacagtcagtcagcagcgcggaattttactattcttttgtggtgctgcttctataggaaccagtgctgaccttacgggtccttccaactatctgtagtgttttatgttctaaaaaaatatatctgtagtgttttgtggtcaacattttttcccatctttatatgattatagtgcgttttttactacttcataagtagtggaatagaccgtggtgcataactcttatgcagctgagtctagtgtctggcaggtccccattactatctactatttgtagattttgatcaataaaattgttctgtcagcgagcagagttatgttgtaggttttgatcaatcaatggttctatcagcgagcacaattgtgccacatcaagactttcttgaacgacgcaggagagatatgtgagatttcattaagatagaaacagtacaacacgaggggaggcatgaagtccgcccctctccacaccaagactattttttttcgtgaacgtgcagagagctgcgcatcattaaattaagagaagaaaacagtccaaaatggaccaaagtacaatgccaaaaaggcagaacgctagaccaccaaattcctgctgcgcacaaaactgcagcctcttctgcgcatgaaaacagtaggacacaaaaggagacaaacagcaaaaagtgccagcaggcccccccacacaactgctcttcactaatcacccagaagatccttggacctaataatggcagcaccaaggcccaagatgcctggcaccggcaagactccaacaatctaactcatccaaaaaaactctttttattccgtttatggaaggtctgacaccataaaaaaccgccttattacgatgaagccataaggctgagtccagtgcacagcctctctctcgcccctgccacgtcagctctcgcctccactctcgcccctgctgctccagtgcacaggctgcagcaggttacagcctcaggctatagcacacgtggaccaatcagaagccgccactcactgtcgcccctcgctctcgcccgcgaagacgccatcgccaacgcgtcgccccgctctcgcctgcctatcgccgggcggtagcagtagcgcccgccgggtcgctctcgcccgcctccagccccgctctcgcctcctgctgggcgctatcgccctcactatagcctgcattggcaccagcctaaacaccaagctcccaagatgatgatactgttaaagtatcttcttttggatttgtgcacttgcttacacatcttcctccaccactcagcaaaagaggactcattagaagcaggagaaagattagcaagccccaacgaagaaagaatgcagcgccaaaattgccgagcaaaaatgcaagtgcaaaggaggtgttggatattctccggctcttgatcacataaaggacaaacctcaggatgatccaacccccttttttgtagtctattagttgtccaacatttattccttattggcaaccaaagaaaaaatttgcatttgggtggagcccaagtcttctataacctcttccatggttcaaaagtaatcgaacccatgaaaaaagccttataacacgatttagaagagaactacccagaggaagaatgaatccacacatgtctatcagcctcattagtaagcaccactccctttaaagcgtcccaaaggtgtaggtattgctgcagcccagacaaattaagaggggtctcaatgtcgctgacccactgccagttctcaagagcatgggtgtgaacttcagaatttctgctgatgtggtaggattggggaacaggatacatgaacagtggatagattgctaactcaccctccctctggagtctctgagctgcttttagatatatttctgcctgcgtctaattggtctctcatatagagatgagctgactcctaagcaaatatctggtcaaatcaatctaactcgtggtactgttcatgcgcagtacctcgtgtccccctggctggctccacttgccataacatattacccttgaaactagattaagctttattctgaggaagtccacaaactagagaaagtacaacttcaatcgtgccttttctgcatcttatggcctgtttggattttagagtttacaaataccgcggtttctaaaaatactatagtatcagatacttgaagtgcttggataccacaaactatgaagttctaaactttagtttcttagataccatgctatttttggagttcttatacattcactagtaccctctttttgtaaaaccgactatgtccggtgtgctgtccatgctctcgctgcagaactgaggtgattgagaagctagttacactgctatcaaccagagcccacccaagccgttacgtacagtgaacggtgttaaatctgagtgaaaagacaaaaatgcccatgcaatttattgtgattttacccctcgttatattatataattgtgatttactgattttacccctgttggggttgctcccgtatgcaatagaaaaaaggtattttggacctttcacccattttccattttttttatttttaaccactaattctgattttcactaacggtgttgagagggaggggcaaactgtagcttcttttttaaaacagaggggtaaaataacaaaattgaaaaatggagggtataatcacaattgtctcccaaaaggaaatcccttcgtctgtcccatgccaaagcacaagtctaaggccaaatccttttttttctcggaagcgcaggagagttgtgcatcattatattaagaagaaagtggttaagatccatgcggaccggtacaagataaaaccaccttacggtggtaaaaaataagaattcaaaaaggggtcatcgtctaaacaaataacggcgaccacatcactactaaggggaccctacaaccctggggtcggagccataagaagagacatgatcttagctccagccatctcccaaagcttcatctccgtttaggagcaaggtcctcaattctatgaccaaacagacaccgatcagtccaaaacaaggtagaggcttcatcaccgacgacggtttgcattgccaccgagaagaacttgacttttgatggaacttggatggtcaaggaagcccaaggatgttctggttctgttttggctagccacaaccacctcatcctgagcgcccatgaaagctcccttaggtttgatataccaaggccgcccagctcaagagggctacaaactttgtttcatgccacgtgatagtgccccctttcacatctttgcggccacgccaaaggaagccccgccgtatcttgtcaatggctttgaaggcccatcatggtaagtctactgccatagcaagatagataaccatgccagtaagaacatgctgaacttgaactttccggccagctttagccatcaaatcagctaaacaaaccagtgattacttaccacaataaccaaacaaagcgtggtttcctaaattacagtagaaaatcatggctttgacaaactgtggtttcattaccatacaaatacagtattaaaaaactgtagttgcaggatattttaatatccaagcaagcaatgtatattttgtgttcccaacagcgagttgcagaaactacttacattgccgcgtcaatacttctattcctgtttttgcaggataaatacaaagacctgcatcctaggttgccagtcattgttgctgagacgcttctttatactgatcctgagattgagctaccactttggttggttcagatgttcaaggtggttttctcataaatagtgtctctggctaattctatatattttagtgctgaccgacctttggtttggctgctacaatttgcattcaggctaataaggcagggaacaagatctcatggggcatgtctggaaaagaggcagatcctgctgctttattcagattgtacataaactacggacgccacgcagaagccaccaacctgctggtggagtatctagagtcgttcgcatcgtcggtaatggattgacaacactgaaatacccaaatgcaagatttttacaagcttataacatatacaaatccctgggaaccatttgcagaggccagtggacgtcctccaccgcaagaagatgtccgccgtttggttcccctacaccgccgtcgagaggctctggtgccagcttggtgagatgcaacgggcagggcacagcgtggatcagtgcgaccggctcaagaagctgctgcacggagccctgatgagccacctgcagcaggttggtagtgccacatccgaaagcaaaaccctgctctgttgcgtgcgtcggtgctgatttgtgttcttgttccacgatcgcaggtcgtggtcgactcggatgatgtgctgtcgtcagttggagatgggcaggggatggaggaccagagcagctgaagtcctgaagatcgtgttgttggcatgtgtagaaaacgatgtgccaccgctggatactgtatgtgattgtttgtgtggtcagctgaccaagagttacgcctgtgtcttttatatagaattattattagatgaaaacaaagacggagcgatggctccatttgtaacgtgagcatggaactgtcgctgatgacgagctgttcacttcccatgtgtagatgtagaaggtggattgacgcatccattacagcactgctgcactggtattgtatcggttctgccttcggggtgtgtaatggggttgttgcgatcgggttcagattagtgttgagcgtcgtggcattagggcatgtacaataccattcaatatatggtcttttaaggggtttctaaagagttaattaaaaaaatacaagagattacctctttatgaaaa

SEQ ID NO: 185 - DNA, 8359 bp, Zea Mays
ccaaatacgcgctctcgtgctcgtgcgcgcgcgtcgcctcccaccccttcgtccgccgttgccgcccgcactctcccttccgccgtcgtgggcgcgcggcgacggggagagaggcaggtgaggtcggaagcggcggcggaggcgggcccccctccgtctactcttactcacgcacaccacggcgcccgcgagctagcgccctagcggagcggaggtaaacgcaaacgccttctcatgcttcgccgcgttgtctgatccgacagggtgctccatgcaacgagtattatcccgtaatttcgtgcgcctgcacgatgcaggtcgaggcgggagaaaggcggttggggctccccggtgggcaggggggggggggggggggtcggaggcggggatggggctcgacggcacggtctcgggggtggtgtcgaggaaggtgctgccggcgtgtggtgggctctgctgcctctgcccttcgctgcgtccccgctccaggcagcccgtcaagcgctacaagaagatcctcatcgacatctttcccgcggagcaggtttcgcaagttccctttcttccgcacgtccgtttatgtcagttatcagtcctattattctccttgctcgccatcagctgcattttcgtgggattttacccgttacgagctggcatttttatgagcatttacattgacactggcgcattacccgttatgagatgagctgcctagagccccaattaactatttctgtctccatcactggaatccttcaactgttcactagatctccccaataaggagatgtcaacggcatatataatggccatctttctgtttgttcacacagctcggttacttttaaacgggctgtggtttccacggatggttatggaccatactacatgtggcagctgttggttctatctgaaaacagacttaatttcatcaacatttgccacaggaagacggaccaaatgtgaggaggattgggaggctttgcgagtatgttgctagaaatcctcatcgcgtgccaaaggcgggctgtgcttctcacctcaagcgtcctacaaattgcatctaatctgttacttccacttcacttgttttctcatgcgtattggtgtctgtgcagatcacagcttacttggagaggaggtgttacagggagttgagaaatgagcagtatgacattgtgaaagttgttgtgctaatataccgcaggctattggtctcttgtaatgaacaaatgtgagttttttgttttttcacattcattttacaatacataacatccatctcatgtctgggccaagagccatagttagttgctgtttccatttggtttttctttctcgttgttgataccggcaagacccagccagatgatgatgtctgctggttagtagtgaaaggactcttagtacccgcaaaaaagggtgctggtgaaaaatcatgtgatttagtttcttgctctcccttagcagcaggaaaggagtctatctatctgcctagctttggtagattccgcccaacgcaacctcttgattgatgtttggattatgtatgtaacttctatatttgcatgctgtaagttcatttcaaactgttgtaaatctgaaagtgaattttctcagtgcaggccgttactggcaaatagtttattaagcatcatacaaacacttttggatcaatcaaggcaggatgacatgtgcatcattggctgtgaaaccttgtttgatttcatagtcactcaggtattcaatttgtgcagtgaacagtggatacattttcgatactcaggatgctatttcagtgtcaatcagtcactgaattatgtgttgattccaggtggatggtacatatcagttcaatttggaagagtttattccaagactctgcaaactttctcaaatagtaagggacaaagagaaggctaatgcactccgtgcagcagctctgcaatcactctctgctatggtaaatctccttcacagtatgatgaacaagttatcattgtatctattaactatgccaccatgttctctgtttcagctcagatcaaacaacagaaagaagttgttagtgggcctacgatttgacaaagtttcttgtagtgttaaaacatagcctaaccaaacgtattgtatgattctcatcacaattggatgcccttcttaaagcactatttatagtcgtcgttgtttggtgttcaagtaatcaagtataagtggtttacccacctctttccaatgacttaagcttttgggttcatgtggttggtacatgaaacctaacattgtatcaaaccaaaaatcttgagtttgagtcctggcagaggcgttatttaagtcatgcactcctttatttccacgtttgcgccttgtctgcggctgcatgtgagagtgttgaggtataactggattgtccacctgttcccaatggcttaagtttttggattcatctggttggtatttacctgtggttccattctgctaaaactggctaagaatcccaataagaaattctagcactttacagccttgattttttatgctgcagttttgtttgtcttgcattcttactacaataatggggacatgttgagtaattttgtgtctttccaaagattgctccacttttggttttcttttgtatttttattgcaatacatatagttattaacccaaaagcaatgcaaagtacaagccaaaatatgctccagcgctgacatactgttcattttgtatgctgaacagatctggtttatgggtgagctctctcatatctcctcagagtttgatagcgtaagtatcttgcagtagttcttgtagtttctctgttttacttatctgtgtccttgaaacttcagaccgtcattatttaccttgtgttagatgtttggtcatgtatgacgaccagaatatcatgctgtacattctaggaatgctgcttagttacgcagatctgctcatgttttcaagctgtaatacaattcctacacctgtaataatacttttggttctatatgtttgctgaatgctatacttgtttgctatgagcagatgtttttttttgcgttaatatatcgtgctcttaaactttttttttcactacgattgtcaggttgtccaagtagtattggaaagctatgagcctcgacaggtgcaaagtgacaatagtgccactgaaaatccaggttgtcagttggttgaagaggtccttaaacccgagggtcatgcctctccatcgacatttatattttctgtgataccttcttgggacagcatagttagtgactatggaggaattcaactgcttatgtaataacattctttgaacttaagtttgttatttcctcttgtttttttagttcttaactgaatcctgtcttgtagggatgatgccaaggatccttatttttggtcaagggtctgtgtgcataacatggccaagctgtccagggaagcaactacattccgccgtgttatggagtccctattttgccacttcgataatactaattcatggtcatccaaaaatggtcttgcactttgtgttctattggacatgcaaatgttcatggaaaagtcaggtgctctattcacattaactcaaagtaaacctttatcaacatgaccactttatttattagctacaagtctacaactggattttgcagggacaaacattaatttgatgatatcagtactagttaagcatctcgaacacaaggccatactgaaacaacctgagatgcaactcagcattgtcgaagtgataactgctcttgcagaacaatcaagagctcaggcttcagcagcaaccatagttgctataagtgaccttgtgaggcatatgaaaaagacactgcatttagctcttggcagcaacgatttggaggtggtaaagtggaatgacaaactccgcatggcttttgatgaatgcatagtccagctgtcaaagaaggtcaatttctctccaattaaagcttagcagtgatttgtacttgctggtctttgcctttacttcccttgctaatttgatgccagtataatgcttcttttctcgaaaacgcaagagagctgtgtgtcattgtattaagaagaaatatagagaggtcctagtggaccagtacacatccaaaagaggcctccttacggcttccaccaacaagtgtacaagaattcatccataactaactacaaaaacaaagaaacgaccaaacaaagcgcaaaacaaaccagccaaaatctagagatcatgcacgccagggatagggctagttaacaaggataacttccttgctccgaccatcacccacaaatcttcttcctggtctgcagatcaatgttttcaagtcggacgatttgctagtcgttctggctgaccgactagggcgattaatcgcgattaatcacgattagtcagacgacttggacaactaatcgtgattggtccaaactgacttgtatgaatcgcgattaatcggacgacttgaaaatagtgctgcagattcaagaacaacctccatgctaggtctctttttgtcaaagacacattcattacggtgcttccacaaggtccaaaccccaaggatgatcaacgacttcaatccttcctgtgccacaccatggacctgactacagatcttatgccaccactccatgaaagctccatcgcctagctggggggccatgttttggatattcacttcagataacgacttaaaccagaattccctagcaaagacacaaccaatcagcaggtgatccaaagtttcttgtgcctgatcacataaggggcatctttcagggtggcacatgccccttttttgcagcctatcagccgtccaaacttccctttcagccaccagccacaaaaagaacttggtctttgggggagggggggggggcaagttttgcatatccggtgtaaaggttcaaactttgtcgacacaatgaaaagaccttcataagcttcttttacagaatatttcccattggccgcaaggcagaaaaaaatccaaatcctctactcctggccgtggctgaactgaggcaaccaagtcccacaaagttaaatactcagaaataactccaacagtgagacctccttgtatgttagaaatccagctctggtttgtgagagcctccaaaactgtcgtcttgtgcaccttctgtttagggatagtctcatataggcggggtgccaggtccctaattctgtgtcccatcagccatctatccgaccaaaatagagtgtgggctccattaccaatttcagtttgcatagccaccgcaaagaattctcttacaaccaggtacctgaataattaaggaagcccgtggtcgatccagttctgtttttgctagccaaagccagcacattctgagtgcccaagcaatatccctaaggctggaaatgccaagtccgcctagctcaagaggccgacaaacctttccccaagccacatgacaatgtcctcttttcgccttcttgcgacctcaccaaagataaccccagcgaatcttatcaatagctttaagcgcccaaactggtaagtccactgccatggctaaataaatgaccatcccagtgaggacagcctggacatggactttccttcctgctttaggcaacagatcaaccttccacccttgtaactgattagcaattttgtcaatgcttggttgcacttgagccttagtaagtttcaagtgtcaatggcaaacccagatagcggcatggaaactcagccacctcacaaggcatcatgttctgcagcaggtccaaatcttgaactccacatcctattggaaagacactgcttttctggacattagtatgtaatccggatgcatgcccaaaaaggtcaagaatatccattataacattgatgtccatggctgccggccgaaggaaaatgaccacatcatcggcgtagacagaaccggtgctgcgctactcttgaggcgatgggttgtaatagaccttcttgctcagccttggtaattaaaaatcccagcacatccataaccagaatgaatagcattggagacagtggatctccttgtggaagtccacggcgatgtagaatctgttttccaggtgacccattgagcaatacttgagttgaggaggtcagaagcagccagctgatcgcgtccatccagatttcaccaaaacccaaatgttgcagcacttcgagaaggaaaggccatgagactgaatcaaaggcctttgaaatatcaagtttgaggagcaatctgggctgtttttgttgattaagcaaacaggctgtttgttgtaccagcatgtaattatcctgaataaagcaacttttaatgaagtcactttgatttggagaaaccatgtcgtgtaacctgctagctaaacggttagcaagaattttggtgatcagttttgcaaaactgtgtacaagactaatgggtctaaaatccttcacttgatcagccacttcctttttcgggaataaggtgataaaagcagtgttgagcacatggaaattcatacgttttctgcttcccactgctgccattatgtcttggtttgcgtaatattatgattatatagttcatatgagctcacaacttagttggtgttgttgatcaggtaggtgatgctggaccagttcttgacatgatgtctgtgatgctagagaacatatcacacactcctcttattgctatagcaactacttctgctgtttatcgcacagctcaaataattgcttcaataccaaatttgtcatataagaacaaggtatgttgttggagcacaaacattgaattcattttatcagtaattattagtgatttttcaatagtttatcctatgttatacttgtcaggtatttccagaagcactttttcatcaattgctgttagcgatggttcaccctgatcatgaaacacgtgttggtgcacaccgcatattttctgttgtccttgtcccatcttctgtttctccttttcccaatttgaaatccctagatcagtgtagaaagcatgatgtccagaggacactctcgagggttgtatctgtcttctcatcttcagctgctttatttgataagctgagaagggacagaaactcctttagagaatatttacatgaaggaagcatgaacagaattttgcatggtattgatgatgaaattgctacccctaatgacttgccaggctcgcaaagcttgagacaaagcctcagactttcttcagtgtctcacaaacattcttatacttctttaaaggaaggtcaaagtcccttgacagagtcaatcaacgaaatggtatgttctaccatgaacaacttgtttgttcccctccatagaaaaaaatccaacatgctgagccttgtgctcagaaatttacaggctagtatagtaacaattgaacaaagtatttgtactattcacatccttttatctaacttttgtatatctcaggaaacaattgtgttaagactaagcagccagcaggccactcttctgctctcatctatttggcgtcaagcactttctccaaaaaatgctcctcaaaactacgaagctattgctcatacatatagtttgcttctattgtttttgggatcaaaggtacttaattttatgagctgccatttgttttgtgtctattgttatctgagttgcagagaattgctatttttcctgcaatttgtttgatttgattatttatcatgatattgtatatcactacgcatgatctttctcgtaaggcttatggcttattgttttctctttattttgtagtcatagtcaccacatattttaatcctcaggttcttagggtgtgggtagtttatttggtcgtgttagtgtcccgcggggagtcttgcgttttgtattcccttgtgcactgtttgaccctcaaggctttgtacccttgttttcttaatgaaatgacgcgcagctctcctgtgtggttcagaaaaaaatgatgcccttttggaatggatatcactgagaacattatttctcttttttttattcttccagacaccaatttttgaggttcttgctcccagctttcagattgcattttctttaatgagccattcacttggaggaacaggtgagcaatttactatttgcctagagttaatcaaaacacatgttagtttggtttctgataattacctaaccatttgtttagattcattgccaccatctcgccgccggtcattatttactctggctacatctatgattgtttttgcctcaagagctttcaatgtggcacctcttctcccaatttgtaaattaatgctcaatgatggaacggtgcgtccaatcgtattcctctcaatcatctctttttttgttttgag

SEQ ID NO: 186 - DNA, 9955 bp, Zea Mays
ccaaatacgcgctctcgtgctcgtgcgcgcgcgtcgcctcccaccccttcgtccgccgttgccgcccgcactctcccttccgccgtcgtgggcgcgcggcgacggggagagaggcaggtgaggtcggaagcggcggcggaggcgggcccccctccgtctactcttactcacgcacaccacggcgcccgcgagctagcgccctagcggagcggaggtaaacgcaaacgccttctcatgcttcgccgcgttgtctgatccgacagggtgctccatgcaacgagtattatcccgtaatttcgtgcgcctgcacgatgcaggtcgaggcgggagaaaggcggttggggctccccggtgggcaggggggggggggggggggtcggaggcggggatggggctcgacggcacggtctcgggggtggtgtcgaggaaggtgctgccggcgtgtggtgggctctgctgcctctgcccttcgctgcgtccccgctccaggcagcccgtcaagcgctacaagaagatcctcatcgacatctttcccgcggagcaggtttcgcaagttccctttcttccgcacgtccgtttatgtcagttatcagtcctattattctccttgctcgccatcagctgcattttcgtgggattttacccgttacgagctggcatttttatgagcatttacattgacactggcgcattacccgttatgagatgagctgcctagagccccaattaactatttctgtctccatcactggaatccttcaactgttcactagatctccccaataaggagatgtcaacggcatatataatggccatctttctgtttgttcacacagctcggttacttttaaacgggctgtggtttccacggatggttatggaccatactacatgtggcagctgttggttctatctgaaaacagacttaatttcatcaacatttgccacaggaagacggaccaaatgtgaggaggattgggaggctttgcgagtatgttgctagaaatcctcatcgcgtgccaaaggcgggctgtgcttctcacctcaagcgtcctacaaattgcatctaatctgttacttccacttcacttgttttctcatgcgtattggtgtctgtgcagatcacagcttacttggagaggaggtgttacagggagttgagaaatgagcagtatgacattgtgaaagttgttgtgctaatataccgcaggctattggtctcttgtaatgaacaaatgtgagttttttgttttttcacattcattttacaatacataacatccatctcatgtctgggccaagagccatagttagttgctgtttccatttggtttttctttctcgttgttgataccggcaagacccagccagatgatgatgtctgctggttagtagtgaaaggactcttagtacccgcaaaaaagggtgctggtgaaaaatcatgtgatttagtttcttgctctcccttagcagcaggaaaggagtctatctatctgcctagctttggtagattccgcccaacgcaacctcttgattgatgtttggattatgtatgtaacttctatatttgcatgctgtaagttcatttcaaactgttgtaaatctgaaagtgaattttctcagtgcaggccgttactggcaaatagtttattaagcatcatacaaacacttttggatcaatcaaggcaggatgacatgtgcatcattggctgtgaaaccttgtttgatttcatagtcactcaggtattcaatttgtgcagtgaacagtggatacattttcgatactcaggatgctatttcagtgtcaatcagtcactgaattatgtgttgattccaggtggatggtacatatcagttcaatttggaagagtttattccaagactctgcaaactttctcaaatagtaagggacaaagagaaggctaatgcactccgtgcagcagctctgcaatcactctctgctatggtaaatctccttcacagtatgatgaacaagttatcattgtatctattaactatgccaccatgttctctgtttcagctcagatcaaacaacagaaagaagttgttagtgggcctacgatttgacaaagtttcttgtagtgttaaaacatagcctaaccaaacgtattgtatgattctcatcacaattggatgcccttcttaaagcactatttatagtcgtcgttgtttggtgttcaagtaatcaagtataagtggtttacccacctctttccaatgacttaagcttttgggttcatgtggttggtacatgaaacctaacattgtatcaaaccaaaaatcttgagtttgagtcctggcagaggcgttatttaagtcatgcactcctttatttccacgtttgcgccttgtctgcggctgcatgtgagagtgttgaggtataactggattgtccacctgttcccaatggcttaagtttttggattcatctggttggtatttacctgtggttccattctgctaaaactggctaagaatcccaataagaaattctagcactttacagccttgattttttatgctgcagttttgtttgtcttgcattcttactacaataatggggacatgttgagtaattttgtgtctttccaaagattgctccacttttggttttcttttgtatttttattgcaatacatatagttattaacccaaaagcaatgcaaagtacaagccaaaatatgctccagcgctgacatactgttcattttgtatgctgaacagatctggtttatgggtgagctctctcatatctcctcagagtttgatagcgtaagtatcttgcagtagttcttgtagtttctctgttttacttatctgtgtccttgaaacttcagaccgtcattatttaccttgtgttagatgtttggtcatgtatgacgaccagaatatcatgctgtacattctaggaatgctgcttagttacgcagatctgctcatgttttcaagctgtaatacaattcctacacctgtaataatacttttggttctatatgtttgctgaatgctatacttgtttgctatgagcagatgtttttttttgcgttaatatatcgtgctcttaaactttttttttcactacgattgtcaggttgtccaagtagtattggaaagctatgagcctcgacaggtgcaaagtgacaatagtgccactgaaaatccaggttgtcagttggttgaagaggtccttaaacccgagggtcatgcctctccatcgacatttatattttctgtgataccttcttgggacagcatagttagtgactatggaggaattcaactgcttatgtaataacattctttgaacttaagtttgttatttcctcttgtttttttagttcttaactgaatcctgtcttgtagggatgatgccaaggatccttatttttggtcaagggtctgtgtgcataacatggccaagctgtccagggaagcaactacattccgccgtgttatggagtccctattttgccacttcgataatactaattcatggtcatccaaaaatggtcttgcactttgtgttctattggacatgcaaatgttcatggaaaagtcaggtgctctattcacattaactcaaagtaaacctttatcaacatgaccactttatttattagctacaagtctacaactggattttgcagggacaaacattaatttgatgatatcagtactagttaagcatctcgaacacaaggccatactgaaacaacctgagatgcaactcagcattgtcgaagtgataactgctcttgcagaacaatcaagagctcaggcttcagcagcaaccatagttgctataagtgaccttgtgaggcatatgaaaaagacactgcatttagctcttggcagcaacgatttggaggtggtaaagtggaatgacaaactccgcatggcttttgatgaatgcatagtccagctgtcaaagaaggtcaatttctctccaattaaagcttagcagtgatttgtacttgctggtctttgcctttacttcccttgctaatttgatgccagtataatgcttcttttctcgaaaacgcaagagagctgtgtgtcattgtattaagaagaaatatagagaggtcctagtggaccagtacacatccaaaagaggcctccttacggcttccaccaacaagtgtacaagaattcatccataactaactacaaaaacaaagaaacgaccaaacaaagcgcaaaacaaaccagccaaaatctagagatcatgcacgccagggatagggctagttaacaaggataacttccttgctccgaccatcacccacaaatcttcttcctggtctgcagatcaatgttttcaagtcggacgatttgctagtcgttctggctgaccgactagggcgattaatcgcgattaatcacgattagtcagacgacttggacaactaatcgtgattggtccaaactgacttgtatgaatcgcgattaatcggacgacttgaaaatagtgctgcagattcaagaacaacctccatgctaggtctctttttgtcaaagacacattcattacggtgcttccacaaggtccaaaccccaaggatgatcaacgacttcaatccttcctgtgccacaccatggacctgactacagatcttatgccaccactccatgaaagctccatcgcctagctggggggccatgttttggatattcacttcagataacgacttaaaccagaattccctagcaaagacacaaccaatcagcaggtgatccaaagtttcttgtgcctgatcacataaggggcatctttcagggtggcacatgccccttttttgcagcctatcagccgtccaaacttccctttcagccaccagccacaaaaagaacttggtctttgggggagggggggggggcaagttttgcatatccggtgtaaaggttcaaactttgtcgacacaatgaaaagaccttcataagcttcttttacagaatatttcccattggccgcaaggcagaaaaaaatccaaatcctctactcctggccgtggctgaactgaggcaaccaagtcccacaaagttaaatactcagaaataactccaacagtgagacctccttgtatgttagaaatccagctctggtttgtgagagcctccaaaactgtcgtcttgtgcaccttctgtttagggatagtctcatataggcggggtgccaggtccctaattctgtgtcccatcagccatctatccgaccaaaatagagtgtgggctccattaccaatttcagtttgcatagccaccgcaaagaattctcttacaaccaggtacctgaataattaaggaagcccgtggtcgatccagttctgtttttgctagccaaagccagcacattctgagtgcccaagcaatatccctaaggctggaaatgccaagtccgcctagctcaagaggccgacaaacctttccccaagccacatgacaatgtcctcttttcgccttcttgcgacctcaccaaagataaccccagcgaatcttatcaatagctttaagcgcccaaactggtaagtccactgccatggctaaataaatgaccatcccagtgaggacagcctggacatggactttccttcctgctttaggcaacagatcaaccttccacccttgtaactgattagcaattttgtcaatgcttggttgcacttgagccttagtaagtttcaagtgtcaatggcaaacccagatagcggcatggaaactcagccacctcacaaggcatcatgttctgcagcaggtccaaatcttgaactccacatcctattggaaagacactgcttttctggacattagtatgtaatccggatgcatgcccaaaaaggtcaagaatatccattataacattgatgtccatggctgccggccgaaggaaaatgaccacatcatcggcgtagacagaaccggtgctgcgctactcttgaggcgatgggttgtaatagaccttcttgctcagccttggtaattaaaaatcccagcacatccataaccagaatgaatagcattggagacagtggatctccttgtggaagtccacggcgatgtagaatctgttttccaggtgacccattgagcaatacttgagttgaggaggtcagaagcagccagctgatcgcgtccatccagatttcaccaaaacccaaatgttgcagcacttcgagaaggaaaggccatgagactgaatcaaaggcctttgaaatatcaagtttgaggagcaatctgggctgtttttgttgattaagcaaacaggctgtttgttgtaccagcatgtaattatcctgaataaagcaacttttaatgaagtcactttgatttggagaaaccatgtcgtgtaacctgctagctaaacggttagcaagaattttggtgatcagttttgcaaaactgtgtacaagactaatgggtctaaaatccttcacttgatcagccacttcctttttcgggaataaggtgataaaagcagtgttgagcacatggaaattcatacgttttctgcttcccactgctgccattatgtcttggtttgcgtaatattatgattatatagttcatatgagctcacaacttagttggtgttgttgatcaggtaggtgatgctggaccagttcttgacatgatgtctgtgatgctagagaacatatcacacactcctcttattgctatagcaactacttctgctgtttatcgcacagctcaaataattgcttcaataccaaatttgtcatataagaacaaggtatgttgttggagcacaaacattgaattcattttatcagtaattattagtgatttttcaatagtttatcctatgttatacttgtcaggtatttccagaagcactttttcatcaattgctgttagcgatggttcaccctgatcatgaaacacgtgttggtgcacaccgcatattttctgttgtccttgtcccatcttctgtttctccttttcccaatttgaaatccctagatcagtgtagaaagcatgatgtccagaggacactctcgagggttgtatctgtcttctcatcttcagctgctttatttgataagctgagaagggacagaaactcctttagagaatatttacatgaaggaagcatgaacagaattttgcatggtattgatgatgaaattgctacccctaatgacttgccaggctcgcaaagcttgagacaaagcctcagactttcttcagtgtctcacaaacattcttatacttctttaaaggaaggtcaaagtcccttgacagagtcaatcaacgaaatggtatgttctaccatgaacaacttgtttgttcccctccatagaaaaaaatccaacatgctgagccttgtgctcagaaatttacaggctagtatagtaacaattgaacaaagtatttgtactattcacatccttttatctaacttttgtatatctcaggaaacaattgtgttaagactaagcagccagcaggccactcttctgctctcatctatttggcgtcaagcactttctccaaaaaatgctcctcaaaactacgaagctattgctcatacatatagtttgcttctattgtttttgggatcaaaggtacttaattttatgagctgccatttgttttgtgtctattgttatctgagttgcagagaattgctatttttcctgcaatttgtttgatttgattatttatcatgatattgtatatcactacgcatgatctttctcgtaaggcttatggcttattgttttctctttattttgtagtcatagtcaccacatattttaatcctcaggttcttagggtgtgggtagtttatttggtcgtgttagtgtcccgcggggagtcttgcgttttgtattcccttgtgcactgtttgaccctcaaggctttgtacccttgttttcttaatgaaatgacgcgcagctctcctgtgtggttcagaaaaaaatgatgcccttttggaatggatatcactgagaacattatttctcttttttttattcttccagacaccaatttttgaggttcttgctcccagctttcagattgcattttctttaatgagccattcacttggaggaacaggtgagcaatttactatttgcctagagttaatcaaaacacatgttagtttggtttctgataattacctaaccatttgtttagattcattgccaccatctcgccgccggtcattatttactctggctacatctatgattgtttttgcctcaagagctttcaatgtggcacctcttctcccaatttgtaaattaatgctcaatgatggaacggtgcgtccaatcgtattcctctcaatcatctctttttttgttttgaggaaataggagggccctctactggttaatatatattaataatagatgaaaaagatgtgtgcaagcaacagaattcaagaaacaaaaaggacaaaaagaaaacaagaaatatcataattggtgctctagccagtcttctataagaaggaaatacttcaatcaagcctccttgaacattttgtttttttgttgggggtggaggaggtaaacatcgcacactcaatgacaggtgcagtaaatgccagctgcgactgattagatatcacatgaaagtaggccttttgtgctttgactctagtctatcctaattagcttgagattaaaaaggctttcttgttgttgcaaagcatacaattcacatgtttacattgtacattaatagcgcattatcattgttcatgtcatttgtgttgcttccatatgttttttttataatcaatgaaggtcctaagctttatgtgccacaactaatcgtagatggatccattccttcatctggtacatgagaacaaacttcaggctgtgaaggactatacggaagatccatcaacatcctatggctcacccgaggacaatcagaatgccttgaaatctctttcagtggtggaactaacaaatagttgctcccgagaatccatgattttaaccattatgaactccataagagatttaccagacgtaattttcgatccattcttcgtaagcactccttatatttgcctgaactgaataccatggaatgtgtggattaacgtccccataacttttgcagttggagttagagaatataaggagtcaactgctgcgtgatttctcccctgatgacgtgtgcccaagtagcgctcactttcttgaatcacctggcaagattgcaccgccatgttctgatgatgacaccgactacgactatcaagaggtatatgtatatctatgggtggtaatggattatgatccagatgtctcttcataattagtttgagcccttaattaattttagttcaaaattgaatagaaacagtgctcgatcctaatccgacccgttccttaatttttatagtgtaaattttagagcccattaccatccgtatgcatatcacctatatatctgcctcactttcttctccatcctaaaggtacacggaaattttgagcaggctgaacttatcgatctgagaaatgacaacaatacttatttggaagcctctgcaactacactggcggctatagctattcctgtgcccacaacaaatcttctcagtatcgatgaacttctagaaacagtatgtccttttttttctcagttcattgttccagccttctctctttgtttgtttataccgccatctgtgtgcacattacaggtcgtgaatgatgtgtcatctcagaccggagggcaatgtttggtgtcaatggccggagacatcccattccaggagatgactagccactgtgaggccttttcgatgggaaagcaccacaagatgtccctgctcatgagcttcaagcaaaacaagcaagcggccatggtcgtcgtgcctgacaatcaggttagccacgctgaagcagcacatacctccgacaagcaggtgcatggacca

SEQ ID NO: 187 - DNA, 10248 bp, Zea Mays
cctgcacgatgcaggtcgaggcgggagaaaggcggttggggctccccggtgggcaggggggggggggggggggtcggaggcggggatggggctcgacggcacggtctcgggggtggtgtcgaggaaggtgctgccggcgtgtggtgggctctgctgcctctgcccttcgctgcgtccccgctccaggcagcccgtcaagcgctacaagaagatcctcatcgacatctttcccgcggagcaggtttcgcaagttccctttcttccgcacgtccgtttatgtcagttatcagtcctattattctccttgctcgccatcagctgcattttcgtgggattttacccgttacgagctggcatttttatgagcatttacattgacactggcgcattacccgttatgagatgagctgcctagagccccaattaactatttctgtctccatcactggaatccttcaactgttcactagatctccccaataaggagatgtcaacggcatatataatggccatctttctgtttgttcacacagctcggttacttttaaacgggctgtggtttccacggatggttatggaccatactacatgtggcagctgttggttctatctgaaaacagacttaatttcatcaacatttgccacaggaagacggaccaaatgtgaggaggattgggaggctttgcgagtatgttgctagaaatcctcatcgcgtgccaaaggcgggctgtgcttctcacctcaagcgtcctacaaattgcatctaatctgttacttccacttcacttgttttctcatgcgtattggtgtctgtgcagatcacagcttacttggagaggaggtgttacagggagttgagaaatgagcagtatgacattgtgaaagttgttgtgctaatataccgcaggctattggtctcttgtaatgaacaaatgtgagttttttgttttttcacattcattttacaatacataacatccatctcatgtctgggccaagagccatagttagttgctgtttccatttggtttttctttctcgttgttgataccggcaagacccagccagatgatgatgtctgctggttagtagtgaaaggactcttagtacccgcaaaaaagggtgctggtgaaaaatcatgtgatttagtttcttgctctcccttagcagcaggaaaggagtctatctatctgcctagctttggtagattccgcccaacgcaacctcttgattgatgtttggattatgtatgtaacttctatatttgcatgctgtaagttcatttcaaactgttgtaaatctgaaagtgaattttctcagtgcaggccgttactggcaaatagtttattaagcatcatacaaacacttttggatcaatcaaggcaggatgacatgtgcatcattggctgtgaaaccttgtttgatttcatagtcactcaggtattcaatttgtgcagtgaacagtggatacattttcgatactcaggatgctatttcagtgtcaatcagtcactgaattatgtgttgattccaggtggatggtacatatcagttcaatttggaagagtttattccaagactctgcaaactttctcaaatagtaagggacaaagagaaggctaatgcactccgtgcagcagctctgcaatcactctctgctatggtaaatctccttcacagtatgatgaacaagttatcattgtatctattaactatgccaccatgttctctgtttcagctcagatcaaacaacagaaagaagttgttagtgggcctacgatttgacaaagtttcttgtagtgttaaaacatagcctaaccaaacgtattgtatgattctcatcacaattggatgcccttcttaaagcactatttatagtcgtcgttgtttggtgttcaagtaatcaagtataagtggtttacccacctctttccaatgacttaagcttttgggttcatgtggttggtacatgaaacctaacattgtatcaaaccaaaaatcttgagtttgagtcctggcagaggcgttatttaagtcatgcactcctttatttccacgtttgcgccttgtctgcggctgcatgtgagagtgttgaggtataactggattgtccacctgttcccaatggcttaagtttttggattcatctggttggtatttacctgtggttccattctgctaaaactggctaagaatcccaataagaaattctagcactttacagccttgattttttatgctgcagttttgtttgtcttgcattcttactacaataatggggacatgttgagtaattttgtgtctttccaaagattgctccacttttggttttcttttgtatttttattgcaatacatatagttattaacccaaaagcaatgcaaagtacaagccaaaatatgctccagcgctgacatactgttcattttgtatgctgaacagatctggtttatgggtgagctctctcatatctcctcagagtttgatagcgtaagtatcttgcagtagttcttgtagtttctctgttttacttatctgtgtccttgaaacttcagaccgtcattatttaccttgtgttagatgtttggtcatgtatgacgaccagaatatcatgctgtacattctaggaatgctgcttagttacgcagatctgctcatgttttcaagctgtaatacaattcctacacctgtaataatacttttggttctatatgtttgctgaatgctatacttgtttgctatgagcagatgtttttttttgcgttaatatatcgtgctcttaaactttttttttcactacgattgtcaggttgtccaagtagtattggaaagctatgagcctcgacaggtgcaaagtgacaatagtgccactgaaaatccaggttgtcagttggttgaagaggtccttaaacccgagggtcatgcctctccatcgacatttatattttctgtgataccttcttgggacagcatagttagtgactatggaggaattcaactgcttatgtaataacattctttgaacttaagtttgttatttcctcttgtttttttagttcttaactgaatcctgtcttgtagggatgatgccaaggatccttatttttggtcaagggtctgtgtgcataacatggccaagctgtccagggaagcaactacattccgccgtgttatggagtccctattttgccacttcgataatactaattcatggtcatccaaaaatggtcttgcactttgtgttctattggacatgcaaatgttcatggaaaagtcaggtgctctattcacattaactcaaagtaaacctttatcaacatgaccactttatttattagctacaagtctacaactggattttgcagggacaaacattaatttgatgatatcagtactagttaagcatctcgaacacaaggccatactgaaacaacctgagatgcaactcagcattgtcgaagtgataactgctcttgcagaacaatcaagagctcaggcttcagcagcaaccatagttgctataagtgaccttgtgaggcatatgaaaaagacactgcatttagctcttggcagcaacgatttggaggtggtaaagtggaatgacaaactccgcatggcttttgatgaatgcatagtccagctgtcaaagaaggtcaatttctctccaattaaagcttagcagtgatttgtacttgctggtctttgcctttacttcccttgctaatttgatgccagtataatgcttcttttctcgaaaacgcaagagagctgtgtgtcattgtattaagaagaaatatagagaggtcctagtggaccagtacacatccaaaagaggcctccttacggcttccaccaacaagtgtacaagaattcatccataactaactacaaaaacaaagaaacgaccaaacaaagcgcaaaacaaaccagccaaaatctagagatcatgcacgccagggatagggctagttaacaaggataacttccttgctccgaccatcacccacaaatcttcttcctggtctgcagatcaatgttttcaagtcggacgatttgctagtcgttctggctgaccgactagggcgattaatcgcgattaatcacgattagtcagacgacttggacaactaatcgtgattggtccaaactgacttgtatgaatcgcgattaatcggacgacttgaaaatagtgctgcagattcaagaacaacctccatgctaggtctctttttgtcaaagacacattcattacggtgcttccacaaggtccaaaccccaaggatgatcaacgacttcaatccttcctgtgccacaccatggacctgactacagatcttatgccaccactccatgaaagctccatcgcctagctggggggccatgttttggatattcacttcagataacgacttaaaccagaattccctagcaaagacacaaccaatcagcaggtgatccaaagtttcttgtgcctgatcacataaggggcatctttcagggtggcacatgccccttttttgcagcctatcagccgtccaaacttccctttcagccaccagccacaaaaagaacttggtctttgggggagggggggggggcaagttttgcatatccggtgtaaaggttcaaactttgtcgacacaatgaaaagaccttcataagcttcttttacagaatatttcccattggccgcaaggcagaaaaaaatccaaatcctctactcctggccgtggctgaactgaggcaaccaagtcccacaaagttaaatactcagaaataactccaacagtgagacctccttgtatgttagaaatccagctctggtttgtgagagcctccaaaactgtcgtcttgtgcaccttctgtttagggatagtctcatataggcggggtgccaggtccctaattctgtgtcccatcagccatctatccgaccaaaatagagtgtgggctccattaccaatttcagtttgcatagccaccgcaaagaattctcttacaaccaggtacctgaataattaaggaagcccgtggtcgatccagttctgtttttgctagccaaagccagcacattctgagtgcccaagcaatatccctaaggctggaaatgccaagtccgcctagctcaagaggccgacaaacctttccccaagccacatgacaatgtcctcttttcgccttcttgcgacctcaccaaagataaccccagcgaatcttatcaatagctttaagcgcccaaactggtaagtccactgccatggctaaataaatgaccatcccagtgaggacagcctggacatggactttccttcctgctttaggcaacagatcaaccttccacccttgtaactgattagcaattttgtcaatgcttggttgcacttgagccttagtaagtttcaagtgtcaatggcaaacccagatagcggcatggaaactcagccacctcacaaggcatcatgttctgcagcaggtccaaatcttgaactccacatcctattggaaagacactgcttttctggacattagtatgtaatccggatgcatgcccaaaaaggtcaagaatatccattataacattgatgtccatggctgccggccgaaggaaaatgaccacatcatcggcgtagacagaaccggtgctgcgctactcttgaggcgatgggttgtaatagaccttcttgctcagccttggtaattaaaaatcccagcacatccataaccagaatgaatagcattggagacagtggatctccttgtggaagtccacggcgatgtagaatctgttttccaggtgacccattgagcaatacttgagttgaggaggtcagaagcagccagctgatcgcgtccatccagatttcaccaaaacccaaatgttgcagcacttcgagaaggaaaggccatgagactgaatcaaaggcctttgaaatatcaagtttgaggagcaatctgggctgtttttgttgattaagcaaacaggctgtttgttgtaccagcatgtaattatcctgaataaagcaacttttaatgaagtcactttgatttggagaaaccatgtcgtgtaacctgctagctaaacggttagcaagaattttggtgatcagttttgcaaaactgtgtacaagactaatgggtctaaaatccttcacttgatcagccacttcctttttcgggaataaggtgataaaagcagtgttgagcacatggaaattcatacgttttctgcttcccactgctgccattatgtcttggtttgcgtaatattatgattatatagttcatatgagctcacaacttagttggtgttgttgatcaggtaggtgatgctggaccagttcttgacatgatgtctgtgatgctagagaacatatcacacactcctcttattgctatagcaactacttctgctgtttatcgcacagctcaaataattgcttcaataccaaatttgtcatataagaacaaggtatgttgttggagcacaaacattgaattcattttatcagtaattattagtgatttttcaatagtttatcctatgttatacttgtcaggtatttccagaagcactttttcatcaattgctgttagcgatggttcaccctgatcatgaaacacgtgttggtgcacaccgcatattttctgttgtccttgtcccatcttctgtttctccttttcccaatttgaaatccctagatcagtgtagaaagcatgatgtccagaggacactctcgagggttgtatctgtcttctcatcttcagctgctttatttgataagctgagaagggacagaaactcctttagagaatatttacatgaaggaagcatgaacagaattttgcatggtattgatgatgaaattgctacccctaatgacttgccaggctcgcaaagcttgagacaaagcctcagactttcttcagtgtctcacaaacattcttatacttctttaaaggaaggtcaaagtcccttgacagagtcaatcaacgaaatggtatgttctaccatgaacaacttgtttgttcccctccatagaaaaaaatccaacatgctgagccttgtgctcagaaatttacaggctagtatagtaacaattgaacaaagtatttgtactattcacatccttttatctaacttttgtatatctcaggaaacaattgtgttaagactaagcagccagcaggccactcttctgctctcatctatttggcgtcaagcactttctccaaaaaatgctcctcaaaactacgaagctattgctcatacatatagtttgcttctattgtttttgggatcaaaggtacttaattttatgagctgccatttgttttgtgtctattgttatctgagttgcagagaattgctatttttcctgcaatttgtttgatttgattatttatcatgatattgtatatcactacgcatgatctttctcgtaaggcttatggcttattgttttctctttattttgtagtcatagtcaccacatattttaatcctcaggttcttagggtgtgggtagtttatttggtcgtgttagtgtcccgcggggagtcttgcgttttgtattcccttgtgcactgtttgaccctcaaggctttgtacccttgttttcttaatgaaatgacgcgcagctctcctgtgtggttcagaaaaaaatgatgcccttttggaatggatatcactgagaacattatttctcttttttttattcttccagacaccaatttttgaggttcttgctcccagctttcagattgcattttctttaatgagccattcacttggaggaacaggtgagcaatttactatttgcctagagttaatcaaaacacatgttagtttggtttctgataattacctaaccatttgtttagattcattgccaccatctcgccgccggtcattatttactctggctacatctatgattgtttttgcctcaagagctttcaatgtggcacctcttctcccaatttgtaaattaatgctcaatgatggaacggtgcgtccaatcgtattcctctcaatcatctctttttttgttttgaggaaataggagggccctctactggttaatatatattaataatagatgaaaaagatgtgtgcaagcaacagaattcaagaaacaaaaaggacaaaaagaaaacaagaaatatcataattggtgctctagccagtcttctataagaaggaaatacttcaatcaagcctccttgaacattttgtttttttgttgggggtggaggaggtaaacatcgcacactcaatgacaggtgcagtaaatgccagctgcgactgattagatatcacatgaaagtaggccttttgtgctttgactctagtctatcctaattagcttgagattaaaaaggctttcttgttgttgcaaagcatacaattcacatgtttacattgtacattaatagcgcattatcattgttcatgtcatttgtgttgcttccatatgttttttttataatcaatgaaggtcctaagctttatgtgccacaactaatcgtagatggatccattccttcatctggtacatgagaacaaacttcaggctgtgaaggactatacggaagatccatcaacatcctatggctcacccgaggacaatcagaatgccttgaaatctctttcagtggtggaactaacaaatagttgctcccgagaatccatgattttaaccattatgaactccataagagatttaccagacgtaattttcgatccattcttcgtaagcactccttatatttgcctgaactgaataccatggaatgtgtggattaacgtccccataacttttgcagttggagttagagaatataaggagtcaactgctgcgtgatttctcccctgatgacgtgtgcccaagtagcgctcactttcttgaatcacctggcaagattgcaccgccatgttctgatgatgacaccgactacgactatcaagaggtatatgtatatctatgggtggtaatggattatgatccagatgtctcttcataattagtttgagcccttaattaattttagttcaaaattgaatagaaacagtgctcgatcctaatccgacccgttccttaatttttatagtgtaaattttagagcccattaccatccgtatgcatatcacctatatatctgcctcactttcttctccatcctaaaggtacacggaaattttgagcaggctgaacttatcgatctgagaaatgacaacaatacttatttggaagcctctgcaactacactggcggctatagctattcctgtgcccacaacaaatcttctcagtatcgatgaacttctagaaacagtatgtccttttttttctcagttcattgttccagccttctctctttgtttgtttataccgccatctgtgtgcacattacaggtcgtgaatgatgtgtcatctcagaccggagggcaatgtttggtgtcaatggccggagacatcccattccaggagatgactagccactgtgaggccttttcgatgggaaagcaccacaagatgtccctgctcatgagcttcaagcaaaacaagcaagcggccatggtcgtcgtgcctgacaatcaggttagccacgctgaagcagcacatacctccgacaagcaggtgcatggaccagcttagtttcgagctcgtaatctgcattttcacaaacgcttaactgcaaatcggggcggaaatatctgggtgatgagatgggttggggaatttcagatgggtgagatgatgaggctgactgttgccgatttgttttcagagcacaaacccgttcctcctgcagagcatcagtgccggcgaggcacaggttgctggcgacgtccagcagccgttcctgaggctgccaccgtcgagcccctacgacaacttcctcaaggctgctggctgctgatttccacttgcagaaaccctgccgtgtaaccaaccgaatgtatcgtgtgtgtacagtggccgtctgcctcaatcttattacaaactaaacaagggtttggatattacatgctgacttgttttcggatcatgccagggtcaatccaaaattcatttaattgtaggattccaaagcaaagggaatgatagatatataaggagaaaatgttgaaatctaacttagatcgtctccaacggcttatctatatggccgtactaacactgttttacattgtatactgtatcgttggtagagtgaaggttaaatataagaataaagaagatag

SEQ ID NO: 188 - DNA, 10248 bp, Zea Mays; identical to SEQ ID NO: 187

SEQ ID NO: 189 - DNA, 10248 bp, Zea Mays; identical to SEQ ID NO: 187

SEQ ID NO: 190 - DNA, 553 bp, Zea Mays; identical to SEQ ID NO: 15

SEQ ID NO: 191 - DNA, 6726 bp, Zea Mays
taacaacatccaaaaatatgataacatatcaaaataattgattggcaaataatgctgaaactcatcaatacggttattctggtctagtaacaagcaaacataaatgagagcattttctcacagatagcctttcagcagttaccgcgaactagaaacatcaagatatcaaacactgcttcaacagaagatattccagcacaaacaataacaagcacagaaactattaagaatctaatcgacagagctagtacactagatcgtatagcttgtttgcttcagtgatgatccaggaaaatggaatgaatcacgttgtatatcatgaggatatcttgcaaatgtcctcgtattcgacagccctgagaaccttcccatcatagaggcctttctcaacctgcacttttgcacagaatttctcagtgtccactgaaagcaacctggcatttgacccccgataagccccattgacaatccgcacaagtccaccaatctgagggatcacggtctcaagctcatcttggtcgaccctgagaacatgcttgctctccaacatctcaatctccccaacatatttatcaataactttcttcaccacccctttctgcttgtagtaccccttctctgccaatgacttgctcatcactttgaccacaatcccagggcacagccagtagtccttcctattgctcctctccttggccttctcctcctccttcatcagctcgtccaatgctgacctctttgcctctgctgccttcacatcctttcccatcttcttggtcaactcattcttctcctggtctcgggtgcctgagccatcctcctcatcaaaaccaaatttcatcttcggcttatcgtcaaaaggattaaccttgggccccggcacagccttctgaagcgcaatcgcaatcttacctgttgccttatctgcctctttcgagtcatcctccggctcctgctcatcatcatccgaacctgaatactctccttcactgccagactcaggctcgccctcggcagcaccaccaccattgggtttagctaaggacttgtgcgcacgctcaatctggcgggcaatcatgcgctcctggcgctcgtcgtcagccatgtctgacttgatcctcttgcgcttgaggcgttccttgacggcctgctccgagtcacggtcgatgtaggtcatgaaccaccccttgggcgtgtcctcgaccttacagtacccctcgcgccccaggaacttgacgaactcggtgagcgtggcccaccgcgtggagttcatgtggacgtggtgccggtcggcgatgtactcgttgtagacgacggtggcggcgacgcgggagtggcggtgcgcgcggcggatgagggagaggaaggactcgaggaactcctcggagaagccctcgacgacgcggtcgggggccatgccgaacacctgcatctgcctctggtgcgactccgacatgcagtggcacttgaacccgttctcgtcgcggcactgcttctgacacatctgacagtaccaccgcagcttctgcagccccttcgccttgatccggtttgcgatcgccttcggcgtcaggaactcgtgcttccccatcgtgcgggagaggcccttgccgcacaagcaggatgggaattacaggtagaagaaggggggagcacgttggtcaaggagacggacgcgaggcgacgaggagtggattattattgtggagagaggcagcggcggaggccggagaggaggccggcgacggcgagattggggagtgcgtgaacggattggggatcgattggattggggcgagggctttgtttttttttgttgctttttttgtttttttattagacaggcgagggctttgttgggacttgggaataagtccaaggctagcaccacaaatgaacgatccggatcgcgtaaacgatcaatcaacggacgagatccagccaccgtgccagatttttcaacccaacgcatgtgaagggcgcgcatcgtatcttatcttcactctccgtccaccaaagcaaaccctacccgctcccttcccgcgccgccgccgccatggactcgatcgacgcagatctcgcgcgcacgcaagaggagcggcgcaggatggaggaggcgctggcggctggcgcgcccatggccgtgtcctccgtcaccttcgacaccgacctctacggcggcgggggcgccgaccccaaccgcttcgcgggctacgacacctccatcccggcctccgaggacgacgccgcggaggacgacgcggaggccgccaaccctgcgccgcgccgcctcgcggcctacacgggccacgccatcgccgccgccgacatcccgcggtcggccgacgacgacgacgggctgcccaagaggtcccagcgcatcatcgaccgcgaggacgactaccgccgccgccgcctcaaccagatcatctcgccggagcgccatgacccgttcgccgctggggaggccaccccggacccctcggtgcggacctacgctgacgtcatgcgcgacgcggcgctgcagaagaagaaggaggacctgctgagggagattgccaagaagaagaaggaagaggaagagaaggagaaggagaggaaggctgccgctcctgagcagcctgccgccacaacaaagcggcgcaacaggtgggatcagtcgcaggacggcgacgctggtgccggtgccaagaaggtgaagacatcctcggactgggatgcccctgatgcgactcctgggattggccgttgggatgccacccccggacgtgttggagacgccacaccctccgtgagaaggaacagatgggatgagacaccgactccagggaggatggccgatgctgatgctacgcctgcagctggcggtgccacccctggggctactccttctggggcttgggacgcgactccaaagctgcctggtggtgtcacgccaacccctggtaagaagcagagatcaaggtgggatgagacaccagcaagtatggggagtgcaacccctggtagtcttggtgctgcaacacctgctggttatactcctggtccaacgccatttggtgcagagaaccttgccacaccaactcctagccagattgctcgtggaccgatcactccggagcagtaccagctcatgcggtgggagcgggacattgaggagaggaacaggcctctcactgacgaggagcttgatgccatgttcccgcaggagggctacaagattcttgagcccccggcttcctaccagcccatcaggaccccggcaaggaagctccttgcgacaccgacacctctggggacaccactttatgctattccagaggagaatcgtgggcagcattttgatgtgcccaaggagctgcctggtgggttgccactcatgaagcccgaggattaccagtactttggaactttgctgaacgaggaagaggaggagcagctatcgccagaggagcagaaggagaggaaaatcatgaaactgttactcaaagtgaagaatggcacacccccacagcgtaaaacagcacttcggcaactgacagacaaagcccgtgaatttggtgcaggaccgttgttcaacaaaatactgcccttactcatgcagccaacactggaggaccaggagaggcatcttttggtgaaggtcattgacagagtactttataagctcgatgagctggtccgtccttttgtgcacaagattcttgtggttattgaaccactgttgattgatgaggactattatgctcgtgttgaaggcagggagatcatctcaaaccttagcaaagcagctgggcttgctactatgattgctgctatgcgacccgacatcgataacattgatgagtatgtgagaaacaccactgctagggcgttcagtgtggtggcttctgctttgggtatccctgcccttttaccattcttgaaggctgtctgtcagagtaagaagtcttggcaggctaggcacactggtatcaaaatcgtccaacagattgctattctcatgggctgtgctgttttgccacacctcaagtcactagttgagatcattgagcatgggctgagcgatgaaaaccagaaagttcgtacaattactgccctttctcttgctgcacttgctgaggctgctgcaccatatggtatagaaagttttgatactgtattgaaacctctgtggaagggtatcagatctcaccgtgggaaggtccttgctgccttcctaaaggccattggtttcatcatccctcttatggatgctctgtatgctagctactacacaaaggaggtgatgcaggtcctcattagggagttccagtctccagatgaagaaatgaagaaaattgttctcaaggtggtgaaacagtgtgtcagtacagagggtgtggaggctgattatatccggaatgacatccttccagatttcttcaagcacttctgggtgaggagaatggctctagatcgcaggaactataagcagcttgtggaaactacagttgagatggcaaacaaggttggagttgctgatattgttgggagggttgttgaggatctgaaagatgaaagtgagccctacagaagaatggtgatggaaacaatcgagaaggtggtagccaacttgggtgcatcagatattgatgctcgtctggaggagctgcttattgatggtatcttgtatgctttccaagagcagactagtgatgacgcaaatgttatgctaaatggttttggagctgtggttaatgcacttggacagagagttaagccctaccttcctcagatttgtggtactatcaagtggcgattgaacaacaagagtgcaaaagttaggcagcaagctgctgatctgatctccaggatagccatagtaatgaagcagtgccaggaggagcagcttatgggtcacttgggtgttgtgctgtatgagtacttaggagaggagtatcctgaggtgcttggttcaattcttggagccttgaaggctatcgtcaatgtcattggtatgactaaaatgactccaccaatcaaggatcttcttcctcgtctgacccccattcttaagaacaggcatgagaaggtccaagagaactgcattgatcttgttggtaggattgctgatcgtggagcagaatttgtgccagcaagggaatggatgaggatttgttttgagctgctcgaaatgttgaaggctcataagaagggtattaggagagcaactgtgaacacatttggttatatcgcaaaggctatagggccacaggatgtgttggccaccctgttgaataacttgaaggtgcaagaacgacagaaccgggtctgtacaactgtagctattgctatagttgctgaaacttgctcacctttcacagttttacctgcccttatgaatgagtaccgggtcccagagctcaatgtccaaaatggtgttctgaagtcactctctttcctctttgagtatattggtgagatgggcaaagattacatatatgccgtcacccccttacttgaagatgctttaatggatagagatctggttcaccggcagactgctgcatctgctgttaagcacatggctctaggtgttgctggcttgggttgtgaggatgctcttgttcatctgcttaactatgtttggcccaacatatttgagacatctccccacgttataaatgctgtcatggaggcaattgaggggatgagggtcgcactaggtgcggctgtgattttaaattattgcctgcaaggtctcttccatccagcaaggaaagtacgagaagtgtattggaagatatacaactctttgtacatcggcgcgcaggatgcacttgttgcttcttatcctgccctggaagacgatggggataacatctttagtcgtccagagttggcaatgtttgtctgattaacgtgagtcttccttactcccaaatttgtttacaatgatattaacacatctgttttgagtttttttttctgtatccttagatcgtagagtgtaaatgttttgggctgctggtcgtacacacttgactgtttggggcacttgctaccatttcagcaagcattatcaaccagtagttgatctgtattgtgtttactttgtcttctgttttctcctgctccttatctatgcaaaggaagaatctgatatgcaaacacattgacaggctggatgtgcatgtccatgtgtcttcatccatattcttatgaagcttgaactgggtggtactctgagttagagctttgtattttacttggtgacacctcttgtgatgcatgtaattgaagttgcatctatttttttgtatttgcaggattgttccttctgaagggggtgcaatgtttaggaattttttttcctggtttactataatgcaactcaaaatctctatcatagtctggtcttactaacgatttgggaactgttttgttttcagggtacctcatgttgcagctgctgaagcgttacactggatttaggaccaatcctaaggctgcagcatgccaattaatccatcaagatcctatattgtgaaggacaaatgacaatcctagcgcgctgtcatctttttatgaatattaggcgttgggcatttaccgtgttttaaaactttgtattacacatggatgttgtattatgtggtgtggacaatggaacgttgcaagctgacctgaacctgattccttactgtattactgagatgttgatatgcatgtcatgttagtgta

SEQ ID NO: 192 - DNA, 6726 bp, Zea Mays; identical to SEQ ID NO: 191

SEQ ID NO: 193 - DNA, 6726 bp, Zea Mays; identical to SEQ ID NO: 191

SEQ ID NO: 194 - DNA, 6736 bp, Zea Mays
taacaacatccaaaaatatgataacatatcaaaataattgattggcaaataatgctgaaactcatcaatacggttattctggtctagtaacaagcaaacataaatgagagcattttctcacagatagcctttcagcagttaccgcgaactagaaacatcaagatatcaaacactgcttcaacagaagatattccagcacaaacaataacaagcacagaaactattaagaatctaatcgacagagctagtacactagatcgtatagcttgtttgcttcagtgatgatccaggaaaatggaatgaatcacgttgtatatcatgaggatatcttgcaaatgtcctcgtattcgacagccctgagaaccttcccatcatagaggcctttctcaacctgcacttttgcacagaatttctcagtgtccactgaaagcaacctggcatttgacccccgataagccccattgacaatccgcacaagtccaccaatctgagggatcacggtctcaagctcatcttggtcgaccctgagaacatgcttgctctccaacatctcaatctccccaacatatttatcaataactttcttcaccacccctttctgcttgtagtaccccttctctgccaatgacttgctcatcactttgaccacaatcccagggcacagccagtagtccttcctattgctcctctccttggccttctcctcctccttcatcagctcgtccaatgctgacctctttgcctctgctgccttcacatcctttcccatcttcttggtcaactcattcttctcctggtctcgggtgcctgagccatcctcctcatcaaaaccaaatttcatcttcggcttatcgtcaaaaggattaaccttgggccccggcacagccttctgaagcgcaatcgcaatcttacctgttgccttatctgcctctttcgagtcatcctccggctcctgctcatcatcatccgaacctgaatactctccttcactgccagactcaggctcgccctcggcagcaccaccaccattgggtttagctaaggacttgtgcgcacgctcaatctggcgggcaatcatgcgctcctggcgctcgtcgtcagccatgtctgacttgatcctcttgcgcttgaggcgttccttgacggcctgctccgagtcacggtcgatgtaggtcatgaaccaccccttgggcgtgtcctcgaccttacagtacccctcgcgccccaggaacttgacgaactcggtgagcgtggcccaccgcgtggagttcatgtggacgtggtgccggtcggcgatgtactcgttgtagacgacggtggcggcgacgcgggagtggcggtgcgcgcggcggatgagggagaggaaggactcgaggaactcctcggagaagccctcgacgacgcggtcgggggccatgccgaacacctgcatctgcctctggtgcgactccgacatgcagtggcacttgaacccgttctcgtcgcggcactgcttctgacacatctgacagtaccaccgcagcttctgcagccccttcgccttgatccggtttgcgatcgccttcggcgtcaggaactcgtgcttccccatcgtgcgggagaggcccttgccgcacaagcaggatgggaattacaggtagaagaaggggggagcacgttggtcaaggagacggacgcgaggcgacgaggagtggattattattgtggagagaggcagcggcggaggccggagaggaggccggcgacggcgagattggggagtgcgtgaacggattggggatcgattggattggggcgagggctttgtttttttttgttgctttttttgtttttttattagacaggcgagggctttgttgggacttgggaataagtccaaggctagcaccacaaatgaacgatccggatcgcgtaaacgatcaatcaacggacgagatccagccaccgtgccagatttttcaacccaacgcatgtgaagggcgcgcatcgtatcttatcttcactctccgtccaccaaagcaaaccctacccgctcccttcccgcgccgccgccgccatggactcgatcgacgcagatctcgcgcgcacgcaagaggagcggcgcaggatggaggaggcgctggcggctggcgcgcccatggccgtgtcctccgtcaccttcgacaccgacctctacggcggcgggggcgccgaccccaaccgcttcgcgggctacgacacctccatcccggcctccgaggacgacgccgcggaggacgacgcggaggccgccaaccctgcgccgcgccgcctcgcggcctacacgggccacgccatcgccgccgccgacatcccgcggtcggccgacgacgacgacgggctgcccaagaggtcccagcgcatcatcgaccgcgaggacgactaccgccgccgccgcctcaaccagatcatctcgccggagcgccatgacccgttcgccgctggggaggccaccccggacccctcggtgcggacctacgctgacgtcatgcgcgacgcggcgctgcagaagaagaaggaggacctgctgagggagattgccaagaagaagaaggaagaggaagagaaggagaaggagaggaaggctgccgctcctgagcagcctgccgccacaacaaagcggcgcaacaggtgggatcagtcgcaggacggcgacgctggtgccggtgccaagaaggtgaagacatcctcggactgggatgcccctgatgcgactcctgggattggccgttgggatgccacccccggacgtgttggagacgccacaccctccgtgagaaggaacagatgggatgagacaccgactccagggaggatggccgatgctgatgctacgcctgcagctggcggtgccacccctggggctactccttctggggcttgggacgcgactccaaagctgcctggtggtgtcacgccaacccctggtaagaagcagagatcaaggtgggatgagacaccagcaagtatggggagtgcaacccctggtagtcttggtgctgcaacacctgctggttatactcctggtccaacgccatttggtgcagagaaccttgccacaccaactcctagccagattgctcgtggaccgatcactccggagcagtaccagctcatgcggtgggagcgggacattgaggagaggaacaggcctctcactgacgaggagcttgatgccatgttcccgcaggagggctacaagattcttgagcccccggcttcctaccagcccatcaggaccccggcaaggaagctccttgcgacaccgacacctctggggacaccactttatgctattccagaggagaatcgtgggcagcattttgatgtgcccaaggagctgcctggtgggttgccactcatgaagcccgaggattaccagtactttggaactttgctgaacgaggaagaggaggagcagctatcgccagaggagcagaaggagaggaaaatcatgaaactgttactcaaagtgaagaatggcacacccccacagcgtaaaacagcacttcggcaactgacagacaaagcccgtgaatttggtgcaggaccgttgttcaacaaaatactgcccttactcatgcagccaacactggaggaccaggagaggcatcttttggtgaaggtcattgacagagtactttataagctcgatgagctggtccgtccttttgtgcacaagattcttgtggttattgaaccactgttgattgatgaggactattatgctcgtgttgaaggcagggagatcatctcaaaccttagcaaagcagctgggcttgctactatgattgctgctatgcgacccgacatcgataacattgatgagtatgtgagaaacaccactgctagggcgttcagtgtggtggcttctgctttgggtatccctgcccttttaccattcttgaaggctgtctgtcagagtaagaagtcttggcaggctaggcacactggtatcaaaatcgtccaacagattgctattctcatgggctgtgctgttttgccacacctcaagtcactagttgagatcattgagcatgggctgagcgatgaaaaccagaaagttcgtacaattactgccctttctcttgctgcacttgctgaggctgctgcaccatatggtatagaaagttttgatactgtattgaaacctctgtggaagggtatcagatctcaccgtgggaaggtccttgctgccttcctaaaggccattggtttcatcatccctcttatggatgctctgtatgctagctactacacaaaggaggtgatgcaggtcctcattagggagttccagtctccagatgaagaaatgaagaaaattgttctcaaggtggtgaaacagtgtgtcagtacagagggtgtggaggctgattatatccggaatgacatccttccagatttcttcaagcacttctgggtgaggagaatggctctagatcgcaggaactataagcagcttgtggaaactacagttgagatggcaaacaaggttggagttgctgatattgttgggagggttgttgaggatctgaaagatgaaagtgagccctacagaagaatggtgatggaaacaatcgagaaggtggtagccaacttgggtgcatcagatattgatgctcgtctggaggagctgcttattgatggtatcttgtatgctttccaagagcagactagtgatgacgcaaatgttatgctaaatggttttggagctgtggttaatgcacttggacagagagttaagccctaccttcctcagatttgtggtactatcaagtggcgattgaacaacaagagtgcaaaagttaggcagcaagctgctgatctgatctccaggatagccatagtaatgaagcagtgccaggaggagcagcttatgggtcacttgggtgttgtgctgtatgagtacttaggagaggagtatcctgaggtgcttggttcaattcttggagccttgaaggctatcgtcaatgtcattggtatgactaaaatgactccaccaatcaaggatcttcttcctcgtctgacccccattcttaagaacaggcatgagaaggtccaagagaactgcattgatcttgttggtaggattgctgatcgtggagcagaatttgtgccagcaagggaatggatgaggatttgttttgagctgctcgaaatgttgaaggctcataagaagggtattaggagagcaactgtgaacacatttggttatatcgcaaaggctatagggccacaggatgtgttggccaccctgttgaataacttgaaggtgcaagaacgacagaaccgggtctgtacaactgtagctattgctatagttgctgaaacttgctcacctttcacagttttacctgcccttatgaatgagtaccgggtcccagagctcaatgtccaaaatggtgttctgaagtcactctctttcctctttgagtatattggtgagatgggcaaagattacatatatgccgtcacccccttacttgaagatgctttaatggatagagatctggttcaccggcagactgctgcatctgctgttaagcacatggctctaggtgttgctggcttgggttgtgaggatgctcttgttcatctgcttaactatgtttggcccaacatatttgagacatctccccacgttataaatgctgtcatggaggcaattgaggggatgagggtcgcactaggtgcggctgtgattttaaattattgcctgcaaggtctcttccatccagcaaggaaagtacgagaagtgtattggaagatatacaactctttgtacatcggcgcgcaggatgcacttgttgcttcttatcctgccctggaagacgatggggataacatctttagtcgtccagagttggcaatgtttgtctgattaacgtgagtcttccttactcccaaatttgtttacaatgatattaacacatctgttttgagtttttttttctgtatccttagatcgtagagtgtaaatgttttgggctgctggtcgtacacacttgactgtttggggcacttgctaccatttcagcaagcattatcaaccagtagttgatctgtattgtgtttactttgtcttctgttttctcctgctccttatctatgcaaaggaagaatctgatatgcaaacacattgacaggctggatgtgcatgtccatgtgtcttcatccatattcttatgaagcttgaactgggtggtactctgagttagagctttgtattttacttggtgacacctcttgtgatgcatgtaattgaagttgcatctatttttttgtatttgcaggattgttccttctgaagggggtgcaatgtttaggaattttttttcctggtttactataatgcaactcaaaatctctatcatagtctggtcttactaacgatttgggaactgttttgttttcagggtacctcatgttgcagctgctgaagcgttacactggatttaggaccaatcctaaggctgcagcatgccaattaatccatcaagatcctatattgtgaaggacaaatgacaatcctagcgcgctgtcatctttttatgaatattaggcgttgggcatttaccgtgttttaaaactttgtattacacatggatgttgtattatgtggtgtggacaatggaacgttgcaagctgacctgaacctgattccttactgtattactgagatgttgatatgcatgtcatgttagtgtacgttgtgttc

SEQ ID NO: 195 - DNA, 6810 bp, Zea Mays
taacaacatccaaaaatatgataacatatcaaaataattgattggcaaataatgctgaaactcatcaatacggttattctggtctagtaacaagcaaacataaatgagagcattttctcacagatagcctttcagcagttaccgcgaactagaaacatcaagatatcaaacactgcttcaacagaagatattccagcacaaacaataacaagcacagaaactattaagaatctaatcgacagagctagtacactagatcgtatagcttgtttgcttcagtgatgatccaggaaaatggaatgaatcacgttgtatatcatgaggatatcttgcaaatgtcctcgtattcgacagccctgagaaccttcccatcatagaggcctttctcaacctgcacttttgcacagaatttctcagtgtccactgaaagcaacctggcatttgacccccgataagccccattgacaatccgcacaagtccaccaatctgagggatcacggtctcaagctcatcttggtcgaccctgagaacatgcttgctctccaacatctcaatctccccaacatatttatcaataactttcttcaccacccctttctgcttgtagtaccccttctctgccaatgacttgctcatcactttgaccacaatcccagggcacagccagtagtccttcctattgctcctctccttggccttctcctcctccttcatcagctcgtccaatgctgacctctttgcctctgctgccttcacatcctttcccatcttcttggtcaactcattcttctcctggtctcgggtgcctgagccatcctcctcatcaaaaccaaatttcatcttcggcttatcgtcaaaaggattaaccttgggccccggcacagccttctgaagcgcaatcgcaatcttacctgttgccttatctgcctctttcgagtcatcctccggctcctgctcatcatcatccgaacctgaatactctccttcactgccagactcaggctcgccctcggcagcaccaccaccattgggtttagctaaggacttgtgcgcacgctcaatctggcgggcaatcatgcgctcctggcgctcgtcgtcagccatgtctgacttgatcctcttgcgcttgaggcgttccttgacggcctgctccgagtcacggtcgatgtaggtcatgaaccaccccttgggcgtgtcctcgaccttacagtacccctcgcgccccaggaacttgacgaactcggtgagcgtggcccaccgcgtggagttcatgtggacgtggtgccggtcggcgatgtactcgttgtagacgacggtggcggcgacgcgggagtggcggtgcgcgcggcggatgagggagaggaaggactcgaggaactcctcggagaagccctcgacgacgcggtcgggggccatgccgaacacctgcatctgcctctggtgcgactccgacatgcagtggcacttgaacccgttctcgtcgcggcactgcttctgacacatctgacagtaccaccgcagcttctgcagccccttcgccttgatccggtttgcgatcgccttcggcgtcaggaactcgtgcttccccatcgtgcgggagaggcccttgccgcacaagcaggatgggaattacaggtagaagaaggggggagcacgttggtcaaggagacggacgcgaggcgacgaggagtggattattattgtggagagaggcagcggcggaggccggagaggaggccggcgacggcgagattggggagtgcgtgaacggattggggatcgattggattggggcgagggctttgtttttttttgttgctttttttgtttttttattagacaggcgagggctttgttgggacttgggaataagtccaaggctagcaccacaaatgaacgatccggatcgcgtaaacgatcaatcaacggacgagatccagccaccgtgccagatttttcaacccaacgcatgtgaagggcgcgcatcgtatcttatcttcactctccgtccaccaaagcaaaccctacccgctcccttcccgcgccgccgccgccatggactcgatcgacgcagatctcgcgcgcacgcaagaggagcggcgcaggatggaggaggcgctggcggctggcgcgcccatggccgtgtcctccgtcaccttcgacaccgacctctacggcggcgggggcgccgaccccaaccgcttcgcgggctacgacacctccatcccggcctccgaggacgacgccgcggaggacgacgcggaggccgccaaccctgcgccgcgccgcctcgcggcctacacgggccacgccatcgccgccgccgacatcccgcggtcggccgacgacgacgacgggctgcccaagaggtcccagcgcatcatcgaccgcgaggacgactaccgccgccgccgcctcaaccagatcatctcgccggagcgccatgacccgttcgccgctggggaggccaccccggacccctcggtgcggacctacgctgacgtcatgcgcgacgcggcgctgcagaagaagaaggaggacctgctgagggagattgccaagaagaagaaggaagaggaagagaaggagaaggagaggaaggctgccgctcctgagcagcctgccgccacaacaaagcggcgcaacaggtgggatcagtcgcaggacggcgacgctggtgccggtgccaagaaggtgaagacatcctcggactgggatgcccctgatgcgactcctgggattggccgttgggatgccacccccggacgtgttggagacgccacaccctccgtgagaaggaacagatgggatgagacaccgactccagggaggatggccgatgctgatgctacgcctgcagctggcggtgccacccctggggctactccttctggggcttgggacgcgactccaaagctgcctggtggtgtcacgccaacccctggtaagaagcagagatcaaggtgggatgagacaccagcaagtatggggagtgcaacccctggtagtcttggtgctgcaacacctgctggttatactcctggtccaacgccatttggtgcagagaaccttgccacaccaactcctagccagattgctcgtggaccgatcactccggagcagtaccagctcatgcggtgggagcgggacattgaggagaggaacaggcctctcactgacgaggagcttgatgccatgttcccgcaggagggctacaagattcttgagcccccggcttcctaccagcccatcaggaccccggcaaggaagctccttgcgacaccgacacctctggggacaccactttatgctattccagaggagaatcgtgggcagcattttgatgtgcccaaggagctgcctggtgggttgccactcatgaagcccgaggattaccagtactttggaactttgctgaacgaggaagaggaggagcagctatcgccagaggagcagaaggagaggaaaatcatgaaactgttactcaaagtgaagaatggcacacccccacagcgtaaaacagcacttcggcaactgacagacaaagcccgtgaatttggtgcaggaccgttgttcaacaaaatactgcccttactcatgcagccaacactggaggaccaggagaggcatcttttggtgaaggtcattgacagagtactttataagctcgatgagctggtccgtccttttgtgcacaagattcttgtggttattgaaccactgttgattgatgaggactattatgctcgtgttgaaggcagggagatcatctcaaaccttagcaaagcagctgggcttgctactatgattgctgctatgcgacccgacatcgataacattgatgagtatgtgagaaacaccactgctagggcgttcagtgtggtggcttctgctttgggtatccctgcccttttaccattcttgaaggctgtctgtcagagtaagaagtcttggcaggctaggcacactggtatcaaaatcgtccaacagattgctattctcatgggctgtgctgttttgccacacctcaagtcactagttgagatcattgagcatgggctgagcgatgaaaaccagaaagttcgtacaattactgccctttctcttgctgcacttgctgaggctgctgcaccatatggtatagaaagttttgatactgtattgaaacctctgtggaagggtatcagatctcaccgtgggaaggtccttgctgccttcctaaaggccattggtttcatcatccctcttatggatgctctgtatgctagctactacacaaaggaggtgatgcaggtcctcattagggagttccagtctccagatgaagaaatgaagaaaattgttctcaaggtggtgaaacagtgtgtcagtacagagggtgtggaggctgattatatccggaatgacatccttccagatttcttcaagcacttctgggtgaggagaatggctctagatcgcaggaactataagcagcttgtggaaactacagttgagatggcaaacaaggttggagttgctgatattgttgggagggttgttgaggatctgaaagatgaaagtgagccctacagaagaatggtgatggaaacaatcgagaaggtggtagccaacttgggtgcatcagatattgatgctcgtctggaggagctgcttattgatggtatcttgtatgctttccaagagcagactagtgatgacgcaaatgttatgctaaatggttttggagctgtggttaatgcacttggacagagagttaagccctaccttcctcagatttgtggtactatcaagtggcgattgaacaacaagagtgcaaaagttaggcagcaagctgctgatctgatctccaggatagccatagtaatgaagcagtgccaggaggagcagcttatgggtcacttgggtgttgtgctgtatgagtacttaggagaggagtatcctgaggtgcttggttcaattcttggagccttgaaggctatcgtcaatgtcattggtatgactaaaatgactccaccaatcaaggatcttcttcctcgtctgacccccattcttaagaacaggcatgagaaggtccaagagaactgcattgatcttgttggtaggattgctgatcgtggagcagaatttgtgccagcaagggaatggatgaggatttgttttgagctgctcgaaatgttgaaggctcataagaagggtattaggagagcaactgtgaacacatttggttatatcgcaaaggctatagggccacaggatgtgttggccaccctgttgaataacttgaaggtgcaagaacgacagaaccgggtctgtacaactgtagctattgctatagttgctgaaacttgctcacctttcacagttttacctgcccttatgaatgagtaccgggtcccagagctcaatgtccaaaatggtgttctgaagtcactctctttcctctttgagtatattggtgagatgggcaaagattacatatatgccgtcacccccttacttgaagatgctttaatggatagagatctggttcaccggcagactgctgcatctgctgttaagcacatggctctaggtgttgctggcttgggttgtgaggatgctcttgttcatctgcttaactatgtttggcccaacatatttgagacatctccccacgttataaatgctgtcatggaggcaattgaggggatgagggtcgcactaggtgcggctgtgattttaaattattgcctgcaaggtctcttccatccagcaaggaaagtacgagaagtgtattggaagatatacaactctttgtacatcggcgcgcaggatgcacttgttgcttcttatcctgccctggaagacgatggggataacatctttagtcgtccagagttggcaatgtttgtctgattaacgtgagtcttccttactcccaaatttgtttacaatgatattaacacatctgttttgagtttttttttctgtatccttagatcgtagagtgtaaatgttttgggctgctggtcgtacacacttgactgtttggggcacttgctaccatttcagcaagcattatcaaccagtagttgatctgtattgtgtttactttgtcttctgttttctcctgctccttatctatgcaaaggaagaatctgatatgcaaacacattgacaggctggatgtgcatgtccatgtgtcttcatccatattcttatgaagcttgaactgggtggtactctgagttagagctttgtattttacttggtgacacctcttgtgatgcatgtaattgaagttgcatctatttttttgtatttgcaggattgttccttctgaagggggtgcaatgtttaggaattttttttcctggtttactataatgcaactcaaaatctctatcatagtctggtcttactaacgatttgggaactgttttgttttcagggtacctcatgttgcagctgctgaagcgttacactggatttaggaccaatcctaaggctgcagcatgccaattaatccatcaagatcctatattgtgaaggacaaatgacaatcctagcgcgctgtcatctttttatgaatattaggcgttgggcatttaccgtgttttaaaactttgtattacacatggatgttgtattatgtggtgtggacaatggaacgttgcaagctgacctgaacctgattccttactgtattactgagatgttgatatgcatgtcatgttagtgtacgttgtgttctccttgtcattttgtttgtgatatcgacatgctatgtttgttgctgaagttgagcacaaatgatttgttggtca

SEQ ID NO: 196 - DNA, 1275 bp, Zea Mays; identical to SEQ ID NO: 21

SEQ ID NO: 197 - DNA, 14212 bp, Zea Mays
cggtccaaccaatggccgggttcgcgcgcgccaccgcccccgcgtccccgtcaccggcggcggcgctgctcaccggcgagcgcctcgtggtcttcctcttcgcggcccgcgtggcactcgcggccccggtgcacctcgccgcggcgctcgcggtcctcgtggcggccgccctcgccgtcgagctcgccgtggacggctccggctccgccccgcttcgccgcttcaggaccaggtgcgggcgggcaggctgcgcacctcctctctctctctcgtccggtgctgtccctctcccttatcgccgtccaattgggtcggggatcttcgggattcggtttcgtgcggatcccggtatcgtgtgggtatcttattgatgcggagtaaattgaagtgaagctccccaacaaaggctagggccaggggtgtaggagctcctttttaagcgagtggtagtgaagtgctcaaagctcctggtggagcaggaaaacctgaaggctgattcgtgcgggtgatgatcaaattcagaattcttcagcgtgtgggctgcattgcacgcgttaaaattgggaagcaaatatgcattataggtgcgctggagacagcgtcatgcgtaaggtctgacttcgtatccagtcaggttgtcggctttgacatgcaatccaattgtggttcgctctccatggcatcgaaatgtgccttagtgtctagtaactatccagtggactccttttcagattaattgggactctgtgatatccgagaccacttgcatgctctcttggggctacaccgcctgtaccctaatgtagttgctaagctcttagttcgcctcttgcgatgtatgcttgctttgtagtgtatactcgataagtgctcttatctgtgcttctagcaagacaaataaaaaaggaaagccattacaatgatgtattgtgtgctacaggccaggtgcttcgtcaggcatacttcttggcgccactactctgcccagcgtcatgctttctcggttaattcaactgtcaaggctcctaccagctgatcctaatggacctaaaggtgtgtttctattttgttgtcttgatcgtgttggctattaaatgaagatctgcctcaatcccacattcaaatttaacaattcaaagggtttcgaagtgatatttgttatctatttcattgtccatcagtttctttaatgtcatggacacaatttgctaattataatctgtcttacatttccagaatttgcatacctggaaatgcagtactgggcagcatcaatcagctgtctcagtgtgctagctttattcctttggcatctacagaagtctcccagcaatgggatctctaaacatttggagtacggctcattgtttatagttttatatctcatgacattctttttgtcctttctactgaagactgatgaaggtaacacacatgtgtaacccacatttaaatgtaatttaggtccagcatactgcataaccaaggaagttctcaaactgatctacttgctggatttattgtaggcttgatggtaacgaccaatatggcgtatatgctctgtcatggagtggctgctgtgatcttaatcaagcatatcctagagaagtttccctcatgcgcatcttttggtttgtaactaaagcctaagatgtaactagaacttcatttcccttctttttcattgtgcctagtttcatgtgctagtagaaattcattatatatcttatatacaggtctaataatcgcttgtggtcttcttggacttattcactccccccccctcatgtatgtacacttttgcatatttcaggggaggcgcttttggtgtcaggtggtcttgttctctactttggtgatatgttggcacatacactttcaaaggtatgctttattctaccagctagtgacaaagatgattctttatttgcttaattattttcccttgcatttgtgatgtcagatggagttctccatgtcatcaaaagcattcattcacacacctcaaactagaagcgatatgaccgcaattattcaggtagggttgcttttgattgtgtgacatgagtcccattgcacatttatgcttacccgctttcattctggtaggggattttacttgtcctttttctacttccgttactatacaagagttctcttaaagtttggtattgctggacaaaggagagaaagcaacaaacacaaacacctgaggaacataagcgaataagaattgattctgccatattctatatctcgttggcggtggtgttaatatttttactgccatcatggacacaccttgtccaaggcctcaaagtgcatccttttgtttggtaagcatcacagttcacctctttatgagaagaggctagaaggcatgcacatggccatgcgtctgtttgtcaatacacttcatttaatttaacactcttaaattgaatatcccctgtgtttaaatatagttgttttgttaatgggattccacatgtcaaattatatattctatgatataatagcaaagttattttgttcatcttatacctgcactatcaaggagtgtttggaaacgaagtatttcaaaaccatggttttggaatactacggttttaagatgccatgagcccatgacacaaccatagtattttttacatcactcttagcaatacgtgtttggagacaaagtatctcaaactatggtattagtgggaaaccctaactcagggttgagtgtttgtattaatagaccaagttagatgggtctggcccattacacaggggtgagactttaattacaagggctaatcccaaaaccctaacaggtactctacccccctcgcagtctcaactctatcctgtacagatgtcgagattggatcgaagtcggtgaatacactcggcggtagccccttggtgaagatgtcggtgaactgtagcgtggtgaggacgctgagaaccccaatgtcactggtagtgacactctcgcggacgaagtgcaggtcgatttccacgcgcttcgtgctctgatgctgcacgagattggtggagaggtagaccacaccgacgttgtcgcagtagacgagggtgacacgctgtagggggttgtggagctcctagagtagctggtgcagctaggaggcctctgccacgccgttggctacaacacggaactcggtctctacactggagcgggagacgacgggctaccgcttggtggcccaacgaggttggcgcccaagaacacgacataaccggaagtggaccggcgcatgtcgggatagtcaacccagtcagagtcagtgtagactacgagctctaacgtttgggagggttggagtagaaggttgtagtcgagggagtcgcagcggtagcgtaggatccgcttgagagcggtgagatggggctctcgcggggtgtgcatatgcaggcacacctgctggacagtgtaggcgatgtcgggcctggagaaggttaggtactggagcgtgccggttaggctccggtaggatgaccggaggcccgtcgtccttagagagcttcgcctgggtgtcgacaggcgtggagcagggcttgcagtcgaacatgccagcccgcttcaggatgtcgatggcgtactggcgctggtggaggaagagaccctgaggccggctctcggcagtgatgctgaggaagtggtgaagaggccctaggtccatcatcgtgaactctcgttgaagggcggcgatcctgcgctgtagaaggtcggcggtgaatgccgtgagcacaatgtcgccgcgccggttgatgaacagggacatgttcgacttggcctcgacaagccgatggaggccaagtaggaggcagagcgactataccatgcccgtggcacctgcttgaggccgtacagggagcggttcaaccaacagaccaggttcgaacgagcggtgtcgatgaagccggtgggctggctgcagtagacagtcttcgttagagtgccgtagaggaaggcatttttgacatcaagctgatggatcgtccaatcccagtagagggagaggacgactcgaacgatggcgaacttgacgatggggctgaaggtctcgtcgtagtccactccgggacgctaggtgatgccctaacggtccttgtagcggtcgagggagccgtccgaggtcagcttgtggcgaaagagctacttgcccgtgaccacgttggtgcctggtggacacggcatcagatcctaggtgtggttggccagcaggggccgcgtagccgccagtggggatcgtcgaggggcggcgcgaacagagagggaacccggggaggcatccggaggagtggcagccgtgttgactgcctgtcagccgccaggatcagctagtcgatggggcggagaacgccgacttcacgacaagtcaccatcgggtggacgtgcccggggtcacggtggatgacgatcgggtggtacacagaaggctcggtgcgggccaacgggtcgtcaggagccaagggaggggccagctcgtggcggtggtagacgagggcagggtcggcgaagcgagccgcgctcgtcgacggtgccggttcggcggggcccgagggagtggcccgttcgcggcggtggtagacgagagtggagtcggcgaagcggtcctcacgtggagcgggcgtggtcgacgggccgtgtgtggcgttggcgtggtcgacggggccgcacgcggcgtgggaagagacgcgagcgggggacacgtggtgcgggtaacgacgcaaggcggggcgtctaggtcgcacgtggtgagggtagaggcgcgagcggtggcgtctaagcctacggagaagcagacgggagcgaccagggttgagggagaacccggatcagactcaaggagagagtcgagatcgacgagtggggaggagccagcaaggggaaacacatcttcgtcgaaaacgacgtgacaagagatgagtatgcggtgggtggcgaggtcaactggtcaagacatcgataccccttgtggttaggggagtaaccgaggaagagacagcgagtggagcgaggagataacttatggggagcgatgaagtgttgtaatagcaggcacaaccgaacacgcgaaggtggttgtaggagggggctgtgccatacaaggcgaagtggggagtgggatggctcaccgccttcaaggggaggcgattgagatgtgtagcggtgttcagggcctctgcctagtagctggcagggtgagacacctgaaagaggaggcagcggatctagttggtggtggtgcgaatgatgcattctgctcggacgttctgggaagaggtgtaagggcacgagagacgcaattgaacgccgtgggagaggaaggagcgagaggcgttgttgtcaaactctcggttgttatcgcactgaagggcacaaaccgggcgaccgaactgggtggagacccaggcgaagaagtgagtgagggtgacgaacgtgtcggactttagccgaagaggaaaagtccaaagaaagtgagaaaaatcatccaaaatcaccaagtagtatttatatctagaaagacttgagtataggagaaaatctagagatcacaatgaactaaatcaaaagcctgctcagctctagaagtagtaggaaatgggagacgagtatgtcggcctaactgacaagcatgatagaagccctcagaatgtcaccctactacatgaaatatctaaattactggtgagcttggtcatgacatcgggtcctggatggccgagacgacgatgccaagtggtggaggaggtggtggagaccataacgggttgggaggacgcgccggtggaggaaggctgaagcatgtagaggggccccgagctatcacagattcacagcggacgaggggggtcctggtggccagatccttcacagagaaaccaaaagggtcaaactcaatggaacaagaattggcgatggtgaaccgacgaacagaaagaagattgtgagtaatgtgaggagctacgagaacattgttgagatagaacggtccaaggagaaccgaggcacatactgaggtgtccggcagagtggaactgtttccaatgacgatcgatgagggatgggagggatgggggaggagcgggataacatgctagtggtggaggtggtgtggtaagacacaccggagtcgaccacccagtcggacgggggtggtcatcgccatagtgctgaaggcggcggcgagggcggctgggtcccaccctccagccagtcggggtgggagctggggcggaggcggaggggcacgccgtagggaggcacagtcaggagggccagcgtaggagggcgggaggcactcgaggcctggcccgaccacatggtgatggtctcggtccaggggttgcagaatgacggctatgcctggccgccaccccgatcggagggaccacctcggggagccgtcgttcccgcggccgcccttgcgggaacggcaacctccgttggcattggaagccagaggaggggccgcaggagcggcgagtggagtgcgggtagtggccccagtcgacggagggctaggggcctggcctcccgagggtgcctgaccgcctggaggagcactatagtgggccagcgctagagcagggtgtaagtgcaatcaaccctaactgagggttttggtgatctaatgacaaaacaaataagggtactaacgagtatgctcctagtatatgctcagaatgtacaggaactaaaggagtcacagccattgttgagaaatcaaataggaagtttcaaggacaaagaaaatacataagcggtacccttgtaaagactctatgcgacagacgtataaaattttatgtatatcttgagtcgcatgatctaattcttccttagtagttttcgcacaggtaatggtgtaatggtgtttgctatagatcaggcctccaaattcaaaagctattttgaaaaccaaaatctcttaagcgctctgtttctgaccgttgttaggtttgagaaactgagagtgttcttgttgaaaagcacttgaacttcttcatctgcagttgagttttttcagctgagttaaacttcagctgagttgaacttcagctgagttgaacttcttcaactacagttgagctttttcagctacagttgagctttctcaacagtagttaaacttcaacttcaattgtaaacctctctgaccatacaccagtggaacctgcctccggggcagttgaactggggttttctctcctgaactttctggtaaagaccagttgaactggtccccaggggcagttcaactggttcctgacccctctgctcagactgtccagcagtctgccagtcagacaagctgacagatatgccagggcggttcaaccggttttggtcaaattgaccagactgtgcagcagtctgccaggggcggttgaaccgccccctagggcggttcaacaggttccgattcgaaaaatctggtcaaacggctagttttgagccgtgactatatatatagacccccacacctctctatttaatgctgctggtcacccccacattcattgctcacctaacttgagacaaaggcacacttcttcctctctcacccaaacttgctctagattcaactcgtttgaaggagccctttggtgtgaggtttgtgcttgtgctcacagatttggttttcctctcccatctcattctaatctcttgatcttgttgcaaacacatcttgtgcgattttggtgttcttgaaaccctagagtttcaagacggtttgaggttgcttgggagtctccaaatttgtggacgaccccaagaagtttgtaatccccgctcttgtgagcaacgtttgagaaaaagaatcccttgaccttggtggtcgggttgtggaggattagggttgaaaaagactcggccctttgtgggctcctcaacggggagtaggacacctttgtggtgtggccgaacctcgggataaatcttgtgtcttgtgttcctgctcgttctgtgattgtgtttttgtttggcaagatagacatatgggtttgctcgtcgggtggatcttgtggtgaaataactctcgtatcttcaccatccacacttttcttatcgcttgaatttttcctctataagaaattcatattatatttttcgcatagttcatagtctagatttactttaacagttggactggttcagagtagttcaacttgcccgtgtagcagttgaactggtctgcaccagttgaactgtagttttaatagtatttcgaagtttgtggtgataattttcaggtttagcctattcacccccctctaggctactttcacaggggcctcagtctccatggtgagctcctcgaggagaagctcgttgcggacggcgtagaaggcggggaagggcacgatccttttgtgagagcattcaggtggccgtagcgggggctgaggtcacacaaaaggttcagcaccaagtacggtcggcgatgggctcgtcgaggtcgtggagagagtccgccatgcccttcatttggcggcagtattctcccacagagagatcctctgagagaactggtgaaactaggcatcgaggtggagcgcctgagcctcccggttctcgaggaactgtccctcgagagcgagccacgcctagaaagtagtgtccgcctggtccggatgatgtcctgtagctcaacggtgatggtgctgtggagccacgagaggaccacgctatccatctggtaccacgatggagacagcggggcgacgaggtcgtcgaggacgtggtcggtgagagcgtacagccgaagcgtgagaacgacctgagctcgccaacgagggtagtgggaggacgtcaacgacccgagcacagtggtggtgcgggccgccgcggctgcactggccgcggccgcggcgttggacgcggcagggttgaaagtcacctagaggggctgaaaggcgaaacctgtaaattataaactttgaacacgaactttacccagggttaggattagaaacaaataataatgaatacgaagtgcggaagagagttcttgctatgagttgctcaatcaatgcggataactttgggagctaactcaaaagattgtaagcaagagaacatagagagagagagagaagaggaggaatcaaatcgtatggtgaagatcaacacaaatgaacacaacgatttgtttcccgaggttcggttccaatgaacctactccccgttgaggaggccacaaaggctgggtcttttcaaccatttcccagtctcaatcgatcactcagacagattgtgtgcttcttcttaaactcaaggatcacaaaggccccgcaaggatcaccacacacttaggtgtcttttgctagctttgcaagtcactagagagtttagaaggagatgaagaaagcacgattaaaagccaagcaacaagagcaacaaatgaaacatgaatcacactccctcaagtcactaatcactaatgatcacttgtcttaagtgtggcacttgaggagattgaaagctttgaatgtgtcttggaatggattgctatctcttgtattgaatgtgtatgagtggaatgcttggatgtgtttaatagaggtggttggggttgtatttattgccaccaaccacttcctagtcgttgttccttttctgccaaccgcggacggtccacccctatacatcaacggctgaaatcacaacggtcagcagtaacggctatatcaacgactacaagtgcatttaatgcatcgtcagatgtcagtcagagcagtcgcggatggtccagttgtgcaccccggacgatccgcgaggacgctaaaaatgcacactggacagtccggtgaattttaaccgcagcgtcctttgcgattcccgagagcagcaagttcgtcgctgagcagcctgtgcaccgaacagtgtccggtgcacactggacagtgtccgatgcacacgcagctggtgctccactggctgtttcagctgaactccttttgctctttttgaacttgacttaattgagtttctggcacttagacaagcatgtttagcacatgaaataattgatcaagtgtctagaacttaccttcacacttgatccatctagatatacttttgcttaacctttgttagttctcaccaagtgtgttgtgcatctaatcaccaaaacaatatggaaatagcccaagggcacatttccctttcacgtagtcatcttggaagttgtcaatcaaggcaagttagaaaaggattaaagcaagcaaccttgaagttgagtaggccacgaaggttgggtctttttcaaccatttccctctctcaatcaatcactcagtccgattgagtgcttcttcttaatctcaaggatcacaaagaccccacaaggatcaccacacttaggtgtctcttgttagctttacaagtcactagagagtttagaaggagatgaaaaagcatgattaaaagccaagcaacaagagcaacaaatgaaacacgaatcacactctctcaagtcactaatcactaatgatcgcttgtcttaagtgtggcacttgaggagattggaagctttgaatgtattggaatggattgctatctcttgtattgaatgtgtatgagtggaatgcttggatgtgttgaatggaggtggttggggttgtatttatagccaccaatcacttcctagtcgttgctccttttctgccaaccgtggatggactacgcccctggttcggacggtccgcccctgtacatcaacggctgaaatcacaacggtcagcagtaacggctatatcaacggctacaagtgcatttaatgcatcgtcagatgtcagtcagagcagtcgcggacagtccggccgtgcaccccggacggtccgcgaggacgctaaaatgcattttaccgaacccgtcaccttcggtttttctggtttttcaacggtcggacggtccgcgcttggtctcagacggtgctcgcttctccttcggacagtccacagtgtaaacgttgttttttcagtgttcctgtccgaggctcgccctagtgtcgcggacggtccgctgtaagggcctagatggtccgtgcataggtgaatttccaaaaagtttctcctgtccggaataatctacgttattccggacagtcgacttagaatagttgtagatgaacttatgcacctgagaaatgatcaactaggcaaactagttagtccataagatttgtgatgggcgtcaaacaccaaatcaattatggaaaatggttaaggctattttccctttcaaaggtcggggaggagggctggaccaacaactgctgcataggagagggagccaccggggggtagagggagtcgtcggcgtggtgaagggagccgccaggagggaagagggagtcgccgccggcgaagtccgtggtgtggcgtgcagtggcgtccgagccgtggagaccgaggctgggtgcgtggaggtcggggtgcttcacgcctaggatatagtcggcactgacgatggccgcggcggcacagcgagcggcgacgtccgcgtcgtggtggccgggtgcgtcgagatcgcggattcgcgagtggctgcacccgtgggggattcggcggccaagaggagactcgcgccaggggagggatggagtccgccatggtggcggccggagcagggcggcggtggccggcgaactgagaggggtggcggcgggctgctgagagaggagaggtggctggcggctaggaggggggagaagagagagttggaaacctagctctataccatgtgggaaactctaaccctaactcaaggttgggtgtttgtattaatagtccaagttagatgggcccaacccattacacaggggtgagactgtaattacaaggggctaaccccaaaaccctaacgggtacactaatggcttgattggttgctcgcatcatcttgtcctgggccactatatgcgttgactttgtgcaagcttgtgtttggttgactgtataaggaagacccgacctgtatgagcagatacaaaataagtcattttgagactatttgggtgcatctaagcatacgacggaatctggcgtacccagtcggccaagctcctgcgagcgtggctcggcgtgctcaggcatccaatcaggtggtaatagtatttagtatacatatgcgagtctagtcataggcaaaaactttgggttggagtagagtttcaaatacttccaaaaataccatggtatcagcaaaaccatagtattcaaaacagagttttttacaatgtacccaaacaccttttggcaaaaaagaaaatactatggtattctccaataccatggttttacctcaaaactccaaaaatactttgcttccaaacgcccccttttagtggttgatagacataatttaatagggactccttggtctatgtgaatagactagctggagaacattttttgaatggactattttcacgtcgtgagatgttattacttgtaaaatctttttaagacgttcactcatgttttcttaatgcttcattatttcacaggattgttaactatatgttcactgattcacatgagcgacttgttttatgtgcatactggatatgtgtaatatatgtatcagttagaaggttctacagtatatcaaagcaaagcaagacagagaggattcttttgcgcaagtattatcatcttgtcgctgttctcattttctctcctgcagttatatttcaggtagtttgtgcgtttttaggtttgatttcaatcagtcctaaaacaaggttcaatttccagcaagatattaagtattttggtctgaaaaatattttgcagcctgctttcttggacttggcatttggtgcagcatttgcagttttcttgatattggagatgttacgagtaagagaccctattcttctgtcttcccaagttcttttcctcatttaatttgagtagcccgtccctcatttgcccccaacaaaatgttaaccatgcctcagatttgggaaatataccctcttggacgtgttgtgcatcagtttatgaacgcctttactgatcatcgtgattctgagattcttattgtcaggtaggtgtgctttaataggcttcattttcttcatttcgtatcccacttcttgtcatgttctgtggttgagaacctaatattatcggtgtgcagccatttttcactcttactgggctgtgcacttccgaaatggatgtcatctggattaaatgaccgaccacttgccccttttgccggaattctcagcttggggataggtgataccatggtaagttctgtgtctgatctgttaatcactatctttgatcatatcatgaattcttttagttttcctttttacctaggcatcaatgatagggtacaagtatggcgtgttaagatggagcaagacaggaagtgagtccagtttcttattcgctatgcccttctagtccttggatctctggactcttacgctttaatcttttctgaaatgatagagaaaacaatcgagggcacggcagcgggcataacatcggtgctagcagcctgctcgatcctggtgtcactcttggcttccagtgggtacattctttcgcaggttcggcttcgctcttgcttctaagcttgctaccgacaacaaaaccaacaaagcaagctttaatgtaacttactgaccatattttctctgacacagaattggctatcgctcctgatagctgtcacattgagcgggttattggaggcatacactgcacagctggacaatgccttcatccccctcgtgttctatagtcttctgtgtctataagggtagcatcctgtacatctaactgaccttgatatcctctttttgtttacacgctattagtatatacgtagtgcaatatgttatttcgacattactcacttggtctcctcggcgcatcaactgcctggtgattcagttcaacagatcacattctgtgtaaccctgcctttcggaagttgagaggacgtgctcatggttgagacagtcggtacaggcatatgaccagaagtagaaaaataaaatgttctccagtcgttcagtagagggtgtttttggcggagctgggcagttggatgctgtacataaagttttttttatatgaacctgttgactgttgttgggacgaacagtattgaaacatgctgtgatgctgatcaatttgatcactctatttgctctttc

SEQ ID NO: 198 - DNA, 1307 bp, Zea Mays; identical to SEQ ID NO: 23

SEQ ID NO: 199 - DNA, 1251 bp, Zea Mays
atggatgatcaggtttacatgcaacctgaagacaacagaatgcggagactatctgaagacactcttttatgtgacagtgaagaatctttaaccaaaagaaaactcgatttttctcagcctattggtggtgacaacagcacagctacacttattccttacccaactattaccggaaacgaggattttgttccatcgtcttctgatgttgcacaagtaggagatggtgatgatgatgtgaccaatttttgcttgacaagacgagagccaccaacttgtgacgttgcacaagtaggagatggtgatgatgatgtgaccaatttttgtttgataagacgagagccaccaacttcaccttttattgattcttgtgtcgacacaacagagttagctgaggattattcaagcttcccctgcgccctaccctctgttgttaactttagtgacattgattcttttcttgatggtattattttataaatacatcaatacttcttcatcatcatcatcatcgtcattattattattactattagtattattattactactaacaatatcctttgttgttctatttcaggttgcgatcaattgttcgaaaaccaaactttggatataatttctcctgttgagatacaccctagcatggacaccgttgcaacactagaagatcttttcctcaagacaaccagacaagcattggcaaatgttcttgatgggctaaatgcccatactttgagagatcctgttcgttgcgccagtctgcgcctcgcttcgtcttgtcttacaggacaatttgctagcattgcaagaattaaagctatgctggacaaattaattaccatttccgaacagctgcagaggacgtattctaactttgaagtggcaagaaaacaagacgaacaaagtactgctaaaatcaagcaggcgcttgacgttcaaagggaagctcttcgcactgttgatgacgaattggcctctgctgaaaagcagcgggcagaaaccatgacgacaattgagaaacttaatcaaattttaatggaggtagagcaaaagagagcgcgacttgaggaaatgcgttctacttcagatttggaggtgaggaaattagagcaggacttgtgtgatgcaattgcagacgcgagcaagaaggctattgatgtttttcagaaggaaacaacggaactaaatcagcaggctgagcaacttcttattgatttaaatagctgtcgatgtcgatctagtagtaactag

SEQ ID NO: 200 - DNA, 744 bp, Zea Mays; identical to SEQ ID NO: 25

SEQ ID NO: 201 - DNA, 4894 bp, Zea Mays
atgacggatcatgcgcgtgaaaatgggtgcaagccgcctgacgtaagttgaatgtgagccaactgaaccgtgctctaatttgcttcttctttcttttcgtttcttttttgtttcttttttatgtatttttgttttatttctgttttctttggccgcacgtatcttatttcctcttctttctttttctttttctctttctttttttttttctttcattttatttattttaatatattatatattattgttattattattttagagaagactactttgcagtatttaactatatatgtatataaaagtaagttgaaatttttattggctctatttacacatacgacgaacggtcatttgcatgtcatatttcccgccatttgtttatctagcgaaataaatttgtatttagccggcgctatgtatgtcatattctatggagaatgtttattggccatatatttacataggtatattttttattccatacatatttcaatattttgaagtgctaaacttttagagcacaaggagattagaagcaatggctactttaaatattcatatattatttatagaacatttgtttatttcatatgaatcgaaatttagtggtcacattaatcgaagttatttagcccacatagcatatattttgatgagaccaaaatccatgtcaacagattccacctcgaggttcggatgcgaaaaaaaaatatgttaacggatccggatctcgaaacttaaataattacacaatgtcattatgtattttaatgaactatgatttattctggcatgatacttatccactcgaaggtatacattcttttacaatatgattttgtatgtataggtgtacgcaatacggtttatcacgacaacgtacacaatcatttttatcgtcttcacatacttatttagttagaacttcctgaaacacgaccacactttccgagaatctgttattttcctaggcgtttttttactaggcgtaggattcgggaggatatgggttttatggatctggggatccaaatgtcggtttataaattatatcttatccaactataatataggaccgatacccctataatctagctgtaccctagtacggcttgaacaataccttgatttattataatacatcccttattttgccgttatgctcacacaactataatataggatatgagcgttgtgacggcttaatatcaaggtacaccttctttcgatattaatatttctattcctttcttctctttaccgaaacatctcactatttttggttgattcagccatcgttggagaatcaattagcatttcttcggtgcaagggttctcagcagagaactggctacatgaaaggtattttgatctcaattttttttgacaatcaaccaccagattttactacaacattatattcttgtatggagttgttatcctagcaagctattaaggggttttgaggaatatccgcttgaaatttgcggtcaatgtcatcattgctttctcttcttttatttagatttgttccatcgtatgaatggattcccttttttcttattatatgtgggtaaatatgaaacatgtaaggttcttagtaaaaaaaattgacacggataattatatgatttttttatcgcatatactttcccacataacctttttttgctgtagatgacggaaaatatgtcacatataatacttgggaagaaaccactttcttacgtggcacaaagtcaaatttatgctccaagaaatagtgatacagccaacccagtgataataaatcgtgaactaaaaattggagaactggataatagtactcgtggatggagatctcagccaaccatttctggaatttgtttttatccatatgcgccctcgaaacaacctgagcaagcattcactttggggaacataatgatatcgcacggtttaggatgggagaattatgatattgagtatattcctattccttctggttatgcggaatggggtacaataattcttgcaaaacattcttttaatttaagaggagatggagaaggtatggattttatctatggggccatttattgttctttatttggacaatattccatctcaccttcgctactgaaatctttgctggaaagatggaatccagattcaaacacttttttattccacgatggcgagcgtactgtaacactcttagatttgcattatattatgggtttaccagtggatggggaattttatgaggagtatgtcccgtcacatcatgagcgtgaaccatccatgttattatatcccaagtgcttatcacaacttttggaggtttgggatgaattacaagtggggggagaagtatcgctgcaagaatggtgtgactgttttcataatggaccaaggggactttcacactctgatgatatggaactttcgcttatttacaaagcagctttcatagcgatatggctttgcggctttgctattatcggagggggaccacgaattcgtcgcggggtattggtgatggcttcatggatagctttggggcgacgttttgctttggcacaaccaactttgtgttccttatattactccctgagattaatcagtacagacccggttggaccttcttatatgaaaagacctaggcctgttcattatctcattggatggatgggagtttacctaaaacacgcttttgttaacaaagtgacgaagccacgtattccttattatgaccatcctaccaggaaacctatgctagtgaacatgttatttcgaacttctaaacatttcaatcctgaaagtgcttctgattttctgcgtaaagattctaacatcctttggcacccatacaaaccccactctgccaaccatctacgcacaccaccttcgtcctagatcagcaaaatattttgtttatgcattcggcgtggcttgcttccttttaggcgtgataacatatgcattgcggagccgtaccatccagatcgtgtaactcgacagtttaggcttgatcaggtcgtcccatatcttgtactgaagagcgtgtatacagaagatgattttggggtcgcttactcttactgggcacatcttttacgcccaataaatcaggatttcagttgtctccctaatgagactcgtattggcagctgcacaatatattggataaattggtatagaaaattttcagagccttttatctcggtattgacgaacttgcgctgtggttgtgcacgtggtcgtgtacattataatgatagaaaaagactagcagcaggcaagattattcctcgtcgtctttctccatctgattttgtggtgatacgagaagtgcgtgaggagcagcatactaagtatattgcatttatcaaggctagagaggaggtgataattagtccttggaaaaaatattacatgatttcttacgcagaaggcccaacacttcaactctaccggccaatgtatgatttaccttcttttctttactttatattcctggtagcatacatacatatcacgggttcatgaattttattttactatgtacccaactctccctttttagcactctgagataaatcttatggagggttcttctttgcaacacgtacctaccgataatacatcacagaaagactccatggatgatcaggtttacatgcaacctgaagaaaacagaatgtggagactatctgaagacactcttttatgtgatagtgaagaatctttaaccaaaagaaaactcgatttttctcagcctattggtggtgacaacagcacagctacacttattccttacccaactattaccggaaacgaggattttgttccatcgtcttctgacgttgcacaagtaggagatggtgatgatgatgtgaccaatttttgcttgacaagacgagagccaccaacttgtgacgttgcacaagtaggagatggtgatgatgatgtgaccaatttttgtttgataagacgagagccaccaacttcaccttttattgattcttgtgtcgacacaacagagttagctgaggattattcaagcttcccctgcgccctaccctctgctgttaactttagtgacattgattcttttcttgatggtattattttataaatacatcaatacttcatcatcatcatcatcatcgtcattattattattactattagtattattattattactactaacaatatcctttgttgttctatttcaggttgcgatcaattgttcgaaaaccaaactttggatataatttctcctgttgagatacgccctagcatggacaccgttgcaacactagaagatcttttcctcaagacaaccagacaagcattggcaaatgttcttgatgggctaaatgcccatactttgagagatcctgttcgttgcgccagtctgcgcctcgcttcgtcttgtcttacaggacaatttgctagcattgcaagaattaaagctatgctggacaaattaattaccatttccgaacagctgaagaggacgttttttaactttgaagtggcaagaaaacaagacgaacaaagcactgctaaaatcaagcaggcgcttgacgttcaaagggaagctcttcacactgttgatgaggaattggcctctgctgaaaagcagcgggcagaaaccatgatgacaattgagaaacttaatcaaattttaatggaggtagagcaaaagagagtgcgacttgaggaaatgcgttctacttcagatttggaggtgaggaaattagagcaggacttgtgtgatgcaattggagacgcgagcaagaaggctattgatgtttttcagaaggaaacaacaaaactaaatcagcaggctgagcaacttcttattgatttaaatagctatcgatctagtagtaactag

SEQ ID NO: 202 - DNA, 1705 bp, Zea Mays
gcactgcggcagtactgcaataccaagttaccaacttatcacagttatcagaactgaggcatattacctatccacgaggagcagaaagcatatttgccaatgtatgctggggttggtatgcagccattgcaatctctgtatctctagttccttccatggatctctggttgatgttagcggatccaattatcacatattcatcatccacaatcatgcctttcgagtgcacatacaccatgaatctcctattattccgagcttggtcctgattggatatccaagctgcagcataattgtatttttctggggaaatcagtacctccttcagttttgggcatttctaaagtgtaccggaatcagcagcagaaaacagaacaatagtatgcagtctaacctgtgggttactggttgagaatggtccactagatgtgcaagtagtgtcctcggcttcacggttaccaaggcagaagaaattcaggtaatcctgtggctcatatgtaccatctagtcctacttctttcatggccttatagattatctcatacataatttgcattgtcattttctacattgtaaaaggaaagaaaaacgagttacatgagataagttactatgctgtttcaaaaagagtatatggaaaatggcaattttgcaaagcccactgttggcaaccgcaaacttccaattttctcgccacagagggtggcacacgactaaaggtttatggaagagataatacactgatcctaaacaaggtgaaaaaatcctaatacaagccaaattctaacatagacaaaaaatgggttctaagacctaacctgccaataaagaatctttgcgtaagagtaccagtaggattgccctcaggccacattggaactactatataagctgaaaatctctcattcgaataaatcttgtttgcaattttcagtgctatctcagtgggtatcagattattagcacctgcaatgtactgtacttcacagtcctgaattttggaaacttcagatgatcataagggagaagtagatttttatgctcaccaacatctctatgtgaatcccagttaaatgaagagccaaggaagtactggttctcaatatagatgaaatgttgagcacctcggatggcattcacatatgttgtatgcacgctcatatcaatcagtacattttcccacaaacaagattctgttaatcaaagcaaaagtttgtattaagcacaaacaatgaagcactgcatatgtggtcaacataggtatagtctagtacatttaccttactagtggcctcccgtggatcttttggaaaacccttgacagaattcgaatcaattgatcggaaaatctgctttcaaggtgaaatttgctcagggctcgaccatgaatgtcagaattatttattttgcagtgatttatggagccctttggtagacttacctgcatgtcccatctctctggatcatcgtcatttgaatagatttcgtcgtcaatagaaataatatcaggtatcttgttgatccacagcagcgaatcattatgcgacctcgacaattttgacagtttcttagcggcactgcgctttgatgcctttaaccagcgctcctcaaagtttttcaggacatcgtatgcttctggaccgtcgatcttggaatgcaagtcatgccatggctctcttgggccgcgagcatcttcaacctgaga

SEQ ID NO: 203 - DNA, 1309 bp, Zea Mays; identical to SEQ ID NO: 28

SEQ ID NO: 204 - DNA, 987 bp, Zea Mays
atggcgatcgacgacatcggcgtgtcagcacgacgatttccattcgacgaagacgatggcatgacgattcgtttgggctttttgtcgagcactaatgcagggtgctgggatggagcagacgctcgaccacagacgaaagacgacgcgctagctatgaaggctgagcagggaacccaggttcaacggcgagcagggagacatgctaaaatcccagacacgacggcgacccccagaagggcaaagacgaggtcgagtaggagaggacggggtttgacgggctcgacgcgacggcaaggacataggtcgtggggcacatgacacggacaaaggacgaatgccggggctatcagctcgttgcgcgatcgggtgacgacgacgaacagccgagcgcggtaagaacgacaacgggccaagcaaaggagctcgcgtgcgcacagggaagaaccgaagaactcacagccacctgcaagcaaatcgacgccagcgagggagctgggataagggataggggtgcggccaacagagctgggcgagtgcgatctgagatggagcagcggcggccaggcgtcatggcagagggcaggaccgagctcggcgttgggggctggggcaccatgggaacaagcttgaggaggagagggtgtggggagctgccgacggcgcagcaggggcaaggtccaacgagtggcagcggaggaggaccgctagagctcgacgccggtcaagctcgccagagagaggggctgggcgagcgtagcagcaaggcgaggtcgcggtcgggcgagctggagagccatggatgggaggagcagaggccgagctggggccgagaccaggggcgcacgcaccaaagaaggcgagctgcagcggccagcaaaggagctcgcgccggagctccaaatcgacggcgtgagagccgagcagggcgcgaccgtgggagctccagggcgcacggctgaaaaaaaaatcccaggcggatgagggaga

SEQ ID NO: 205 - DNA, 1708 bp, Zea Mays
gtttgtaccttactagttcatccaagtaagtatacaacaacaacaaaaccttttaatcccaagcaagttggggtacgctagagttggaacccaacaaaagttgcatgttaaggtttagcacatatatagctgttttccatgcaattctattcaaggctaaatctttgattatattctatcctttcaagtctccttttattgcctcttcccatgtcaacttagggcttcccctggctctctttccattactattgtgtcctaggatcccactatgcactggtgcctctgaagatctctgttagacatgtccaaaccatctcagtcagtgttggacaaacttttcttcaattggtgctacccctaggctagcgtgtatatcatcgttccagactcgatttcttcttgtatggccataaatccaacacatcatacccattttcgcaacacttagtctgctgaacatgtctttgtgtaggttaaaattctgcaccatacaacatagcgggtctaatcgtcatgctataaaactcgcctttttagcttttgtggtatcctcttgtcacatagaatgccaaatgtttgacatcacttcattcaccctgctttgattctatggctaacatcttcatcaatacatctcgttatgacattattattgtcatatattgcttctgttctcccttttagaactagatgtaaaactcaagtatagctgaatttatctgattaatctactgcatctgtgtgcgaatgtgaaacttgcagatttctccctgcccctgatgatagtttagcacttgacatagcgtataccatctatatgaagtttggagaccttgcaagtgctttgagaatttctctgcaacttgagaaagtgagtacatgcttattaaacatgccattccatgctgctttgcttagaaccaaattcaacttgcacattttgctgtctgtagtctgtgcagtatgtgaagcaagtctacacagcaactgatgatcttctgctgaagaaacagttctcttatctcattgcgcgccatgtaagcagacaccccattttcatttacatatgtatctgctttgactgatactttgcattcattcatgcacacagtcctgagatacatcttatactttatttgctctcgccctcaccataaagttctttccccttgtctgaacaattgtctgttttcttaagggtttggctatggagattgatgacgagatctctactgatgataatgataaggaggctttacaagaaatagtaaataatactaagttgagtgagggatatcttactcttgctcgcgatattgaggtcatggagcctaaatccccagaggatatatacaaggtgatgtatattttactgcttatcatatttttaatagcatgattaaatcctctataataattatgatcatgttttacaatatgtaggtccatttgattgatggccgtggtgccagctccagtcttgattccgcaagacagaatttagctgcaacatttgtaaatgcatttgtgaatgctgggtttggcaaggttagcttttgagacagttactaatgtttgtgaagaaagacttcattttaacttctttttattactttgtgcaggacaagttgatgaccgctccatctgattcacccagcagcgggtcttccggaaattggttatttaagaacaaggaacatggaaa

SEQ ID NO: 206 - DNA, 4316 bp, Zea Mays
tacttgcatagtaatgatactcatgttgtagctggagccttgctaggtattggaattgtcacttgcggggtgaagagtgattgtgatcctgtatgtgctccactttgttagcttgtcttgaccccttgcaccctgcatctttttttccctaataccctcacttttctaccaggcgtttgctattctcatggagtatattggcaaagatgactcaaacattcgtattggagcaatattgggtcttggaattgcatatgctggttcccagaaagaagaggtgggactagtgcttgtaatctagtcttgctgtctcataacttggtgttttgttccttatcaatactctttttaattttcagcttaaaatgcatctatctgctgtgctgggagactctcaatcacctcttgaagtattggtcttctcagccattgccttggggttggtgtttgttggttcttgcaatgaagagattgcacagtctattatatttgccttgatggagcgtagtgaggctgagttggcagagcccattatacggttgcttcctgttgcgcttggccttctataccttggaaaacaggtaattctaagcatcctgtagatatggttctgatttcaatgtttacagctttgttcagtaatataagtaatagattgctgctaggcttaacatatccatctggagcattgtttgttgcttctcacttcaagtatttacctattttgttcatgtaaaactgatcaattggtcattgttaattaccaggccttatgtttttgtggtttttgttgtgtggatccaataaaaatgccaaactgctctggtgctgattgctactaccttttttgtttactctgttgcaacatgccactttccaatgtagtctaacccctgtcctggaatatagtgtatagaagcaataaaaaactgtgctagaatacatgggtttttgtgggacataaggaccattttgcattaaataggccacaaattcggtaggtggtactgtgttgttacttgccagttattgagcaatcttcctttagtcacacggaagacagcatatataattaaattgattaggaaatgaagtgagggtactgggtacatctgtcttttgtattcttccttggtctgtcttaaaatctcaaggatacactatattccagtacggaaggagtagatccatgcacctgctatcactaataatcaagtcctatttcaggatagtgtggaggctaccgcagaggtctctaaaacatttgatgaaaagatagggaagtactgtgatgtaacacttatgtcgctggcatatgccgggacaggaaatgtgcttaaggtattgtatactattctttaatggaaaggtttctagcagattcagtttttaaagaagtttaagatatttggttgatagcatgtaatcaactctatttgcaggttcagaaacttcttggcatttgttcacagcatcttgagaaaggtgaaacacaccaagggccagctgtccttggaattgctcttattgctatggctgaagaattaggagctgaaatggctgtacgttcacttgagcgtcttctgcagtatggcgagcagaatataagacgagcagttcctcttgctcttggtatactctgcatatctaatcccaaggtatgtgaataaatccgtcttatgcacactaaagttctgatacgtgaaatctaattcctgctagaaacaatgcctgatcaatgcagttttaagaactttggtttcacacaaactttattatatctgaatccttgagtgccccatggggattttttttgttctagttggtaaatttctaaattgtgttttatatctaagaaatatctctaatgagaccatctgaatggaattactgcatgattgtgctaactatttgatgcacttgcaccagcacacaaacatgtgtgaattctatataacttttcaggttaaatttttgaccatgaaaccaatctaccaaaagtattgtctctatggactgacttttttaagtgttcccatgatacaagttttttatttattttcctgatactgttggacccagaacccatcaagctgtatccatccatattagaagtaaatcatatcataacaggccagttttactgcagcacctttctataaatagattgcgacatggataattttgcatgccactttcattattaaaagcttgccaaaatcatcttcactgcaatttgtactctctaattccgtggcactgacaattttctttgcacaagtatactattttaaaaactgaagatcatgtatgctgaaagtatgggccttgtaacatcatccctgtgttgtcaattcttgtgacatcatccctgtgttgtcaattcttgtgacttttcatatataattgataattgatgtgtcaaggtacaatgtttgaccaagtagaatcataaagtgctctacatttggaatcatattgtgatctacaccgtatgtgtctgttccaacaacttatgaagattctgatttcacaacccaagtttggcagtttcttgtgtagcattctttcaaacatctaaaaatactctgttttggtatgtgataatttgagtgctgaatggttgtttagtggtgcattcatttgaacaggttccattaagttaaaatgtctggttatatgccatcaggcattctgattgcttttctaacacctgccttaggtgaatgttatggacacactgagtagattgagtcatgatgccgatgccgatgtgtcaatggttcgtatctatcattttttcctagcctttccttccttatactatatcttatatatctggatattaaatttctccaggctgcaattatctcattgggtttgattggtgctggcacaaacaatgccagaatagctgccatgcttcgcaatctttcaagttattactacaaagaagcagctcatctgttttgtgtaagtatagatcgataatgatcatttggcatccttcatggacttttggttccttgattgttttttagtttcatgctttgattaattttattgtgtacatcatcaggttagaattgctcagggccttgttcacctcggaaagggcttgttgaccctttctccgtaccattctgatagatttcttctttccccgtgagtgtcggtctctttgcacccattttcacttgtgaatgccaccgaattgcattagaacctttttttcttgttctgttttctcaggatggcacttggagggcttgtaactgttctgcatgcgtgtcttgatatgaagtccactatcctagggaaatatcactacatactttacattattgtcctggcaatgcaggtatgtttgttagtcattggctcataagctctttttttgcattagaacctttttctttctcataagctcttttttgctttacagcccaggatgcttttaactgtcgatgaggatctgaagcccctctcagtacctgtccgcgttgggcaagctgtggacgtggttggtcaggcaggaaggcctaagacaattaccggctttcagacacactccacaccagtcttgcttgcagcaggggagagagctgaactagcaactgaaaagtaagctgcattcagaatgaatggtgtgtatatgttcaaggaaatgttaatcactgtttgtttgtctgtgttgtgcagatacatcccactgactccggtattagagggctttgtgattttgaagaagaacccggagtaccatgaagagtgaaacgctttagcatgccaaatagcatggtgtttcggaggctcgtgcacatggcagtcttcaagccctggcgcacccctcgtcgagaaatcgctcgccctttgctcaacccttcgcctggagttcatgttgaattcttaccagagttgtggctaactgaaagctgtcttcggttgtgctgatatacgattgtatctgtacgattgtagcaattactgggacagcttactctgtatggtgtggtgataacgtggcatagcatttttggcgctggtctaggttagtccttgtgttgacatggtgcaccatcattataagttttctgtattttatggatccgttctgttcgtgtgtactggaaacattgtacacatgatatgtaagtgtgcctccatgtgtatgtgtgccttcgtgtgtgttttggttttgtctttagcatggcttttgtccccttaaaaccaaaagacaaatcaaagcgctcgaagcaactttttccaaatatatatggaagaacttttagggctgatttggtgatgggtttttt

SEQ ID NO: 207 - DNA, 7004 bp, Zea Mays
cttcaaagcctgtatcatgctgcatcttccttccctggggccagcctcgtcaactccgcttccggttctggcccattggcgttgcttcacatcgacgcgcctgcgccgccggtccgccgcgccttcccctcccttctcccccgcgtgccctcctattccttctctgcggcggcgtggggagctgcatctgccttcgtctggaggagtgggaagaagcgctgccgaaggggtgatttacgaagccagagagcggctgggagcaagagtgcctgggactgggagttgaagctagagaggctagttgcttgtttggtgcgctgccaaaccgccctcaacatctgacccgtctctccctcacttccacggttccagcgagcggcgcaaccgcgcaactgagcagctagcatgggggacgaagaagatgatcctgactggctccgcgcgtttcaggtaccaactcgcttcatctccctcctctgccacatctccacttgaggtctccatggctaaatcgtggcatctgcggcgttaagcaagttttcctcctcttggagcaaaatcttttgttccggatgcaagatgccacctcttgccttagatttccacttcacttctaaatcccgcccttgaacctctagcgaaataggtcagagctcaggctgcagtgcgctaactaaaccctggaattctgaatttcggtttgcttgtggtggggaaaaaaaatcagcttctgccttaagctttccagaattgtttttttgttccaaaacctatacttcagagttcagatagctattatgtagcagttaccacttatcatatggattcaaacattttttgggagcaggcaccaactgtggcacctgtgatgctttcttctggttcagatacctcccctgaagctagtcctacaagaaccagtacatctagaaaacaaaacaagggagagaagcacgctagtccagatcatgcacgtgatagagatggtgcttcacaaaataaaaacaaaatctcagcagctactagaagaaaaaaccttgtcagtaaaaaaggtagaactaacgtacctgcttttttttagtactataaagattctgaggcacgactgcttaaggtcttgatccgtatttgtcacatggttgcttattgattcttttgacaaatatgcagaggggtcaactatggatgaaaaacaagctaatactcctagacgcttggtatggattttgagtgttgttttagattccctgtctccgattcatgatatcttggtaactaggctggtattgtgttgttgatttatccaataaaaacgataacatagcactatgtaattcctactgtactattagagacttgggctactagtttggccatcaatgagactgcaggtgtcattttattgtatagattaactgtacctgtttgtaatgttcgatttatattgtgatattagtgatcagacactgcaagtgttatgctttgttttaaattcactatgtcatagtagttgtaagctggtcctataatttgtagttaattttgacacataatattttttgtagactccaaagaaggatatggtaacactttcatctggttctgatgcttcaccgggaaacagcctttcgagggcccatgaagataaccatgaagagggctcacttagcactgccaagagaaagaatgctcaacaaactaagactaaaaaaacaaaggatgctggaacaaaaactggtgcagaccaagcagggagtaaggcactttaatatgacttccatttcagttgatacttgactcagatttggaatgacatgtacatgttatattgtttcatgattcaacatcaagatggagatgctgaggatgatgtgcaagataaactcacagggaactctgtaaagtgccaactcacccatctctccattttattctttttgctccttcaaatttggatgtgaaactctaggcctttagctattttcagttgtatatctgcagctctttgatggagtttatgctcctctaaatgccaggtctcccagaggttaccattaatatttccagataaagttcaacgttcaaaggtatactcaactctaagaggcactgcttatatggagatcactctcatttaaactttctacatttgcgataaaatgttatcaacatgcctgtgatctctcccctgattatatttatattcttattctcagaagaaatgttttagcattgctgtgtaaggaatgtgctatatagtgtgtagacttataatcaagacatgacatagatacttgtttgtgtatgtgtatgttcacttggagatagtaataatttaacaatgggatcatgaatgatttcaagtcgggcgacttgctagtgatacacctgggcgaccaggcgactaatcgcgattaggacgacgactaagtcgactaatcgggtcctagtcgacctggtcgtccctacagcgctcctgcatatttgcaggaactatgtatataatattgatatatatagcaatatagcatatagaaagcaataccaaacataagtacataacaattatgaatactggaactggacaattcagatttcagaacatgaacatcagtcactaactcaattatatatagcaatatagcatataggaagtaatactaattaccaaacatagcaaatatgaatactggaagacagaattcagattgcaggtttcagaacatgaacaattgaacatcagttactactcagtagtcactaactcactaattcatatgatgcagagttgcagacttactagttactacataaatgccaagtacatacttactattgacctaaactaggagtccagggcaactaatcgcccccacccaaattggacgactaatcgtgtttagtcgacgactaatcagacgaccggacgattagtcgagcagatcgggtcggcctccctagtcgtgctaacagaaccgactagcccgactaatcgcgattagtcggacgacttgaaatcacttgtactaaaacacaatagccacacatcctttttttctctgcttgaacaatgcatgacggcatgagagctgcattttatttccttaatcaatagaggaaaaatgattaacttgcaactgttcacccaatgtgaaatctgaaaataggaaaatgaaaaattaatgtgccacaaagcaatttaaaagacgacaacaacaacacaatgggtagaagcaaaaaggccttgagttggttaggtggcttgagtagcgtcctaaggttctaggtttaactccctgtaggagtgtaggagtaaattttcagactgggacaagcacatgtctaaggccgaccctagtcatggtcattctcccatgggctacaacaccgctgtgtatgggtatggcaagggttcgggagttttctcgacatacatgggtcttctttttattgcaatgcccctacaacgcaattttattgatttaaaaaagatgacagagaaataatacaagaaagacaaatttaaagaaacaaagaaggatagaggggataaagctagtgagagtttagccataaagtaaccctgaatttaagagaggagctaaatctaagcatttgaagcttcatcatgtcgttgaagcaactccgccaagaggagggagcaagattcctgaagataaactcatttctatgcttccagatgttctaggcaactaaaggcaaaatttccatgaagaaactgtggccgaacgcactcttgacaacctcaatcatcgtgaaaaaaatgcagatcttgattccaccgaattcccacataatttcaacattctgagcagaaagggcaatcaaacagaaggtggtatgttgtctcataattgagctcacaaaggatgcaattgacgttaccgccagaagtcagaaagccttccttctaagaaggttctttgagttagttctatccttgaagactaggcagacaaaaatcttgattttcttacgaactttggactgccagacccaattgaaaggggatggtggttgattggatctgaaatttaaattatagaacttggaagaactgaaattggcattggcccaaggatatatccaactgtctttgccctccctagaattttacatttggccaataatctcacagaaggcttgatattcttcagtggcttgaggagagaggagtatgaaagttatcttccagattcatattgtcaagaaattcctgaagagaacattctttctttctggcgaacgaaaagaggcaagggaaggaatgtttgggggaattattgttccaaacattctgccaaggaggatggtcctttcatccccaacccgaggcatagcatggcctctaaagagatccaccaatctgaaaacatctttccaccaaaaggagcctttttcaatagagccatgagggacccggctcgaagtatagtatgagctccaaacaagattcagccaagggatatcttgcctgccatagagtttatgcaagaatttcatcagaagagctatattctgaattttcaagtcgagcactcccagaccacccttattcttaggacatgtcactttatcccaagcaatgaggggatttcgatgagcattatcattattacctctccagggacaatcccttctcacagcctgggggctgtgttgcttcccacgggccaagttctttcacacaatgggataaaaagctccagcctacttaactaacaatatctcgatctcaagagcttcggcagtgtaccaaagagccatgtacttgtggttataatttctgaaatgtgtatctgtatttgtgtgttaaatggaactgtgaagaactagactctggataataacttggtgaatctatcattccctgttatcccgtaacgtattatacgtatacctgcaacattctgacttcatatccaaaattttattttatttatatttcccaacttatgatcattgttctgtttgtttgttttctttctaggcattgattgaatgtgatggtgactcgatagatttaagtggagatattggtgcggttgggaggatagtagtttcaaatggtcctactgcaaaacaggatttgttgttggacctgaaaggtactatcaagtaatttatcattttgtgtacttcattggatactgaattgtaatgatgtatctgtcaaaggatatccaaggccagatatcagtactgaagctttgcttaagcatttaaaccagccctgttttgtcttaaaccttgatatgtgcaatattccaagacttgagcatcttatttgttctttctaactcacacaggaacaatatacaaaacaactatagttccatccaggacattttgtgttgtaagttatgttccaaacccaagtagagatttattgttttgtgatggtgttttaaccctcgatgtattttcctttcaggtgagtgtgggacaatcagaagcaaaggttagctatccactgtcgatttacacatagcatttagtgtactatttctgcttgttaattgggttacgtgttcaatttctcaattccacttccattccaaggcaattattcgccacaacccacccactgttttttctgtgcagatagaggctataatgaatgacttcattcaactggaaccacaatccaatttatttgaagcagagactatggtggaaggtacatacttccgacagttactgcagggtgccggctaatatgacttcgtttttctccagagtgtctctaatgtataaaattggcatgcataaagcaaatttgtaaatagtagcatggtcgtatcgtttttttatcgagctatttctttgtgcatcgacatttgtggctgtagcttcattcttgcactatgaggaagtaaccaggcttcatgaagatgtggttccattatttatatgataatagcctgtgctacaatttttctgctctaatattaaagatctatcattcgtttaggtacccttgatggattcacatttgattcagatgaggagggtgacaaactctatgaaccacaggctaatcaaaacgatctgaataataacgaagatgaaggtcaacctaaggcaaagaccaaaaggaaagcagagaaaacaacggtgtgttttcttgactctgataactaacctgcaactatgaatagctagaatccggatagttgtgatgtacagaggtttcgaattcatggtgcttcagatttacagtgattgcagattctgtattggatttgtttacagtgattctgtattgcagatttagcagtagtgctgttcttattttttacgcttccttggtgttgccatctttgatgaagtaagcatttcacaaaaccataacaaaaaaatgcagtacaacatgctaccatcaagtttgtggtaaatttgtcgagacaaccagtactccagattttggcttgctgtatgtatgaagcctcgcttgcttctacctgctagcgtgttgcaattctctcatagtagcccttacaggtcacaacttgatcttatgtaactacaaaagatttatttacttggaacaatgcttgtcgcaacatcatagtgcacctgcctgatggaggattctaatctgtttcccgtgacctgcaggggaaggcaccgaagaaggcgaaggttgcaggaaagggccctaaaaagggcacgaggaaaacccaacctgcgaagagaggtaggaaggctaagaaatgatgacatgttgatttcctcggataagaagaaaaagtctattgagaacctggatagctggcaacaaagatgtgaatttttcaacgcatagtcatggctgtgaggcgcgtcgtcagttcaacatcatgcagtacttgttttagagagagagaacatgtaaagctgtaaacgttgttgtgtactctatgagcgttcagctttggatcattgaaaagaccgagatgttcacgtggaggcgaactgacttctctattttttttcacaaa

SEQ ID NO: 208 - DNA, 7040 bp, Zea Mays
cttcaaagcctgtatcatgctgcatcttccttccctggggccagcctcgtcaactccgcttccggttctggcccattggcgttgcttcacatcgacgcgcctgcgccgccggtccgccgcgccttcccctcccttctcccccgcgtgccctcctattccttctctgcggcggcgtggggagctgcatctgccttcgtctggaggagtgggaagaagcgctgccgaaggggtgatttacgaagccagagagcggctgggagcaagagtgcctgggactgggagttgaagctagagaggctagttgcttgtttggtgcgctgccaaaccgccctcaacatctgacccgtctctccctcacttccacggttccagcgagcggcgcaaccgcgcaactgagcagctagcatgggggacgaagaagatgatcctgactggctccgcgcgtttcaggtaccaactcgcttcatctccctcctctgccacatctccacttgaggtctccatggctaaatcgtggcatctgcggcgttaagcaagttttcctcctcttggagcaaaatcttttgttccggatgcaagatgccacctcttgccttagatttccacttcacttctaaatcccgcccttgaacctctagcgaaataggtcagagctcaggctgcagtgcgctaactaaaccctggaattctgaatttcggtttgcttgtggtggggaaaaaaaatcagcttctgccttaagctttccagaattgtttttttgttccaaaacctatacttcagagttcagatagctattatgtagcagttaccacttatcatatggattcaaacattttttgggagcaggcaccaactgtggcacctgtgatgctttcttctggttcagatacctcccctgaagctagtcctacaagaaccagtacatctagaaaacaaaacaagggagagaagcacgctagtccagatcatgcacgtgatagagatggtgcttcacaaaataaaaacaaaatctcagcagctactagaagaaaaaaccttgtcagtaaaaaaggtagaactaacgtacctgcttttttttagtactataaagattctgaggcacgactgcttaaggtcttgatccgtatttgtcacatggttgcttattgattcttttgacaaatatgcagaggggtcaactatggatgaaaaacaagctaatactcctagacgcttggtatggattttgagtgttgttttagattccctgtctccgattcatgatatcttggtaactaggctggtattgtgttgttgatttatccaataaaaacgataacatagcactatgtaattcctactgtactattagagacttgggctactagtttggccatcaatgagactgcaggtgtcattttattgtatagattaactgtacctgtttgtaatgttcgatttatattgtgatattagtgatcagacactgcaagtgttatgctttgttttaaattcactatgtcatagtagttgtaagctggtcctataatttgtagttaattttgacacataatattttttgtagactccaaagaaggatatggtaacactttcatctggttctgatgcttcaccgggaaacagcctttcgagggcccatgaagataaccatgaagagggctcacttagcactgccaagagaaagaatgctcaacaaactaagactaaaaaaacaaaggatgctggaacaaaaactggtgcagaccaagcagggagtaaggcactttaatatgacttccatttcagttgatacttgactcagatttggaatgacatgtacatgttatattgtttcatgattcaacatcaagatggagatgctgaggatgatgtgcaagataaactcacagggaactctgtaaagtgccaactcacccatctctccattttattctttttgctccttcaaatttggatgtgaaactctaggcctttagctattttcagttgtatatctgcagctctttgatggagtttatgctcctctaaatgccaggtctcccagaggttaccattaatatttccagataaagttcaacgttcaaaggtatactcaactctaagaggcactgcttatatggagatcactctcatttaaactttctacatttgcgataaaatgttatcaacatgcctgtgatctctcccctgattatatttatattcttattctcagaagaaatgttttagcattgctgtgtaaggaatgtgctatatagtgtgtagacttataatcaagacatgacatagatacttgtttgtgtatgtgtatgttcacttggagatagtaataatttaacaatgggatcatgaatgatttcaagtcgggcgacttgctagtgatacacctgggcgaccaggcgactaatcgcgattaggacgacgactaagtcgactaatcgggtcctagtcgacctggtcgtccctacagcgctcctgcatatttgcaggaactatgtatataatattgatatatatagcaatatagcatatagaaagcaataccaaacataagtacataacaattatgaatactggaactggacaattcagatttcagaacatgaacatcagtcactaactcaattatatatagcaatatagcatataggaagtaatactaattaccaaacatagcaaatatgaatactggaagacagaattcagattgcaggtttcagaacatgaacaattgaacatcagttactactcagtagtcactaactcactaattcatatgatgcagagttgcagacttactagttactacataaatgccaagtacatacttactattgacctaaactaggagtccagggcaactaatcgcccccacccaaattggacgactaatcgtgtttagtcgacgactaatcagacgaccggacgattagtcgagcagatcgggtcggcctccctagtcgtgctaacagaaccgactagcccgactaatcgcgattagtcggacgacttgaaatcacttgtactaaaacacaatagccacacatcctttttttctctgcttgaacaatgcatgacggcatgagagctgcattttatttccttaatcaatagaggaaaaatgattaacttgcaactgttcacccaatgtgaaatctgaaaataggaaaatgaaaaattaatgtgccacaaagcaatttaaaagacgacaacaacaacacaatgggtagaagcaaaaaggccttgagttggttaggtggcttgagtagcgtcctaaggttctaggtttaactccctgtaggagtgtaggagtaaattttcagactgggacaagcacatgtctaaggccgaccctagtcatggtcattctcccatgggctacaacaccgctgtgtatgggtatggcaagggttcgggagttttctcgacatacatgggtcttctttttattgcaatgcccctacaacgcaattttattgatttaaaaaagatgacagagaaataatacaagaaagacaaatttaaagaaacaaagaaggatagaggggataaagctagtgagagtttagccataaagtaaccctgaatttaagagaggagctaaatctaagcatttgaagcttcatcatgtcgttgaagcaactccgccaagaggagggagcaagattcctgaagataaactcatttctatgcttccagatgttctaggcaactaaaggcaaaatttccatgaagaaactgtggccgaacgcactcttgacaacctcaatcatcgtgaaaaaaatgcagatcttgattccaccgaattcccacataatttcaacattctgagcagaaagggcaatcaaacagaaggtggtatgttgtctcataattgagctcacaaaggatgcaattgacgttaccgccagaagtcagaaagccttccttctaagaaggttctttgagttagttctatccttgaagactaggcagacaaaaatcttgattttcttacgaactttggactgccagacccaattgaaaggggatggtggttgattggatctgaaatttaaattatagaacttggaagaactgaaattggcattggcccaaggatatatccaactgtctttgccctccctagaattttacatttggccaataatctcacagaaggcttgatattcttcagtggcttgaggagagaggagtatgaaagttatcttccagattcatattgtcaagaaattcctgaagagaacattctttctttctggcgaacgaaaagaggcaagggaaggaatgtttgggggaattattgttccaaacattctgccaaggaggatggtcctttcatccccaacccgaggcatagcatggcctctaaagagatccaccaatctgaaaacatctttccaccaaaaggagcctttttcaatagagccatgagggacccggctcgaagtatagtatgagctccaaacaagattcagccaagggatatcttgcctgccatagagtttatgcaagaatttcatcagaagagctatattctgaattttcaagtcgagcactcccagaccacccttattcttaggacatgtcactttatcccaagcaatgaggggatttcgatgagcattatcattattacctctccagggacaatcccttctcacagcctgggggctgtgttgcttcccacgggccaagttctttcacacaatgggataaaaagctccagcctacttaactaacaatatctcgatctcaagagcttcggcagtgtaccaaagagccatgtacttgtggttataatttctgaaatgtgtatctgtatttgtgtgttaaatggaactgtgaagaactagactctggataataacttggtgaatctatcattccctgttatcccgtaacgtattatacgtatacctgcaacattctgacttcatatccaaaattttattttatttatatttcccaacttatgatcattgttctgtttgtttgttttctttctaggcattgattgaatgtgatggtgactcgatagatttaagtggagatattggtgcggttgggaggatagtagtttcaaatggtcctactgcaaaacaggatttgttgttggacctgaaaggtactatcaagtaatttatcattttgtgtacttcattggatactgaattgtaatgatgtatctgtcaaaggatatccaaggccagatatcagtactgaagctttgcttaagcatttaaaccagccctgttttgtcttaaaccttgatatgtgcaatattccaagacttgagcatcttatttgttctttctaactcacacaggaacaatatacaaaacaactatagttccatccaggacattttgtgttgtaagttatgttccaaacccaagtagagatttattgttttgtgatggtgttttaaccctcgatgtattttcctttcaggtgagtgtgggacaatcagaagcaaaggttagctatccactgtcgatttacacatagcatttagtgtactatttctgcttgttaattgggttacgtgttcaatttctcaattccacttccattccaaggcaattattcgccacaacccacccactgttttttctgtgcagatagaggctataatgaatgacttcattcaactggaaccacaatccaatttatttgaagcagagactatggtggaaggtacatacttccgacagttactgcagggtgccggctaatatgacttcgtttttctccagagtgtctctaatgtataaaattggcatgcataaagcaaatttgtaaatagtagcatggtcgtatcgtttttttatcgagctatttctttgtgcatcgacatttgtggctgtagcttcattcttgcactatgaggaagtaaccaggcttcatgaagatgtggttccattatttatatgataatagcctgtgctacaatttttctgctctaatattaaagatctatcattcgtttaggtacccttgatggattcacatttgattcagatgaggagggtgacaaactctatgaaccacaggctaatcaaaacgatctgaataataacgaagatgaaggtcaacctaaggcaaagaccaaaaggaaagcagagaaaacaacggtgtgttttcttgactctgataactaacctgcaactatgaatagctagaatccggatagttgtgatgtacagaggtttcgaattcatggtgcttcagatttacagtgattgcagattctgtattggatttgtttacagtgattctgtattgcagatttagcagtagtgctgttcttattttttacgcttccttggtgttgccatctttgatgaagtaagcatttcacaaaaccataacaaaaaaatgcagtacaacatgctaccatcaagtttgtggtaaatttgtcgagacaaccagtactccagattttggcttgctgtatgtatgaagcctcgcttgcttctacctgctagcgtgttgcaattctctcatagtagcccttacaggtcacaacttgatcttatgtaactacaaaagatttatttacttggaacaatgcttgtcgcaacatcatagtgcacctgcctgatggaggattctaatctgtttcccgtgacctgcaggggaaggcaccgaagaaggcgaaggttgcaggaaagggccctaaaaagggcacgaggaaaacccaacctgcgaagagaggtaggaaggctaagaaatgatgacatgttgatttcctcggataagaagaaaaagtctattgagaacctggatagctggcaacaaagatgtgaatttttcaacgcatagtcatggctgtgaggcgcgtcgtcagttcaacatcatgcagtacttgttttagagagagagaacatgtaaagctgtaaacgttgttgtgtactctatgagcgttcagctttggatcattgaaaagaccgagatgttcacgtggaggcgaactgacttctctattttttttcacaaattaaaatctatcagtaaggctttgttcgtttatgcc

SEQ ID NO: 209 - DNA, 7040 bp, Zea Mays; identical to SEQ ID NO: 208

SEQ ID NO: 210 - DNA, 7040 bp, Zea Mays; identical to SEQ ID NO: 208

SEQ ID NO: 211 - DNA, 6973 bp, Zea Mays
tccctggggccagcctcgtcaactccgcttccggttctggcccattggcgttgcttcacatcgacgcgcctgcgccgccggtccgccgcgccttcccctcccttctcccccgcgtgccctcctattccttctctgcggcggcgtggggagctgcatctgccttcgtctggaggagtgggaagaagcgctgccgaaggggtgatttacgaagccagagagcggctgggagcaagagtgcctgggactgggagttgaagctagagaggctagttgcttgtttggtgcgctgccaaaccgccctcaacatctgacccgtctctccctcacttccacggttccagcgagcggcgcaaccgcgcaactgagcagctagcatgggggacgaagaagatgatcctgactggctccgcgcgtttcaggtaccaactcgcttcatctccctcctctgccacatctccacttgaggtctccatggctaaatcgtggcatctgcggcgttaagcaagttttcctcctcttggagcaaaatcttttgttccggatgcaagatgccacctcttgccttagatttccacttcacttctaaatcccgcccttgaacctctagcgaaataggtcagagctcaggctgcagtgcgctaactaaaccctggaattctgaatttcggtttgcttgtggtggggaaaaaaaatcagcttctgccttaagctttccagaattgtttttttgttccaaaacctatacttcagagttcagatagctattatgtagcagttaccacttatcatatggattcaaacattttttgggagcaggcaccaactgtggcacctgtgatgctttcttctggttcagatacctcccctgaagctagtcctacaagaaccagtacatctagaaaacaaaacaagggagagaagcacgctagtccagatcatgcacgtgatagagatggtgcttcacaaaataaaaacaaaatctcagcagctactagaagaaaaaaccttgtcagtaaaaaaggtagaactaacgtacctgcttttttttagtactataaagattctgaggcacgactgcttaaggtcttgatccgtatttgtcacatggttgcttattgattcttttgacaaatatgcagaggggtcaactatggatgaaaaacaagctaatactcctagacgcttggtatggattttgagtgttgttttagattccctgtctccgattcatgatatcttggtaactaggctggtattgtgttgttgatttatccaataaaaacgataacatagcactatgtaattcctactgtactattagagacttgggctactagtttggccatcaatgagactgcaggtgtcattttattgtatagattaactgtacctgtttgtaatgttcgatttatattgtgatattagtgatcagacactgcaagtgttatgctttgttttaaattcactatgtcatagtagttgtaagctggtcctataatttgtagttaattttgacacataatattttttgtagactccaaagaaggatatggtaacactttcatctggttctgatgcttcaccgggaaacagcctttcgagggcccatgaagataaccatgaagagggctcacttagcactgccaagagaaagaatgctcaacaaactaagactaaaaaaacaaaggatgctggaacaaaaactggtgcagaccaagcagggagtaaggcactttaatatgacttccatttcagttgatacttgactcagatttggaatgacatgtacatgttatattgtttcatgattcaacatcaagatggagatgctgaggatgatgtgcaagataaactcacagggaactctgtaaagtgccaactcacccatctctccattttattctttttgctccttcaaatttggatgtgaaactctaggcctttagctattttcagttgtatatctgcagctctttgatggagtttatgctcctctaaatgccaggtctcccagaggttaccattaatatttccagataaagttcaacgttcaaaggtatactcaactctaagaggcactgcttatatggagatcactctcatttaaactttctacatttgcgataaaatgttatcaacatgcctgtgatctctcccctgattatatttatattcttattctcagaagaaatgttttagcattgctgtgtaaggaatgtgctatatagtgtgtagacttataatcaagacatgacatagatacttgtttgtgtatgtgtatgttcacttggagatagtaataatttaacaatgggatcatgaatgatttcaagtcgggcgacttgctagtgatacacctgggcgaccaggcgactaatcgcgattaggacgacgactaagtcgactaatcgggtcctagtcgacctggtcgtccctacagcgctcctgcatatttgcaggaactatgtatataatattgatatatatagcaatatagcatatagaaagcaataccaaacataagtacataacaattatgaatactggaactggacaattcagatttcagaacatgaacatcagtcactaactcaattatatatagcaatatagcatataggaagtaatactaattaccaaacatagcaaatatgaatactggaagacagaattcagattgcaggtttcagaacatgaacaattgaacatcagttactactcagtagtcactaactcactaattcatatgatgcagagttgcagacttactagttactacataaatgccaagtacatacttactattgacctaaactaggagtccagggcaactaatcgcccccacccaaattggacgactaatcgtgtttagtcgacgactaatcagacgaccggacgattagtcgagcagatcgggtcggcctccctagtcgtgctaacagaaccgactagcccgactaatcgcgattagtcggacgacttgaaatcacttgtactaaaacacaatagccacacatcctttttttctctgcttgaacaatgcatgacggcatgagagctgcattttatttccttaatcaatagaggaaaaatgattaacttgcaactgttcacccaatgtgaaatctgaaaataggaaaatgaaaaattaatgtgccacaaagcaatttaaaagacgacaacaacaacacaatgggtagaagcaaaaaggccttgagttggttaggtggcttgagtagcgtcctaaggttctaggtttaactccctgtaggagtgtaggagtaaattttcagactgggacaagcacatgtctaaggccgaccctagtcatggtcattctcccatgggctacaacaccgctgtgtatgggtatggcaagggttcgggagttttctcgacatacatgggtcttctttttattgcaatgcccctacaacgcaattttattgatttaaaaaagatgacagagaaataatacaagaaagacaaatttaaagaaacaaagaaggatagaggggataaagctagtgagagtttagccataaagtaaccctgaatttaagagaggagctaaatctaagcatttgaagcttcatcatgtcgttgaagcaactccgccaagaggagggagcaagattcctgaagataaactcatttctatgcttccagatgttctaggcaactaaaggcaaaatttccatgaagaaactgtggccgaacgcactcttgacaacctcaatcatcgtgaaaaaaatgcagatcttgattccaccgaattcccacataatttcaacattctgagcagaaagggcaatcaaacagaaggtggtatgttgtctcataattgagctcacaaaggatgcaattgacgttaccgccagaagtcagaaagccttccttctaagaaggttctttgagttagttctatccttgaagactaggcagacaaaaatcttgattttcttacgaactttggactgccagacccaattgaaaggggatggtggttgattggatctgaaatttaaattatagaacttggaagaactgaaattggcattggcccaaggatatatccaactgtctttgccctccctagaattttacatttggccaataatctcacagaaggcttgatattcttcagtggcttgaggagagaggagtatgaaagttatcttccagattcatattgtcaagaaattcctgaagagaacattctttctttctggcgaacgaaaagaggcaagggaaggaatgtttgggggaattattgttccaaacattctgccaaggaggatggtcctttcatccccaacccgaggcatagcatggcctctaaagagatccaccaatctgaaaacatctttccaccaaaaggagcctttttcaatagagccatgagggacccggctcgaagtatagtatgagctccaaacaagattcagccaagggatatcttgcctgccatagagtttatgcaagaatttcatcagaagagctatattctgaattttcaagtcgagcactcccagaccacccttattcttaggacatgtcactttatcccaagcaatgaggggatttcgatgagcattatcattattacctctccagggacaatcccttctcacagcctgggggctgtgttgcttcccacgggccaagttctttcacacaatgggataaaaagctccagcctacttaactaacaatatctcgatctcaagagcttcggcagtgtaccaaagagccatgtacttgtggttataatttctgaaatgtgtatctgtatttgtgtgttaaatggaactgtgaagaactagactctggataataacttggtgaatctatcattccctgttatcccgtaacgtattatacgtatacctgcaacattctgacttcatatccaaaattttattttatttatatttcccaacttatgatcattgttctgtttgtttgttttctttctaggcattgattgaatgtgatggtgactcgatagatttaagtggagatattggtgcggttgggaggatagtagtttcaaatggtcctactgcaaaacaggatttgttgttggacctgaaaggtactatcaagtaatttatcattttgtgtacttcattggatactgaattgtaatgatgtatctgtcaaaggatatccaaggccagatatcagtactgaagctttgcttaagcatttaaaccagccctgttttgtcttaaaccttgatatgtgcaatattccaagacttgagcatcttatttgttctttctaactcacacaggaacaatatacaaaacaactatagttccatccaggacattttgtgttgtaagttatgttccaaacccaagtagagatttattgttttgtgatggtgttttaaccctcgatgtattttcctttcaggtgagtgtgggacaatcagaagcaaaggttagctatccactgtcgatttacacatagcatttagtgtactatttctgcttgttaattgggttacgtgttcaatttctcaattccacttccattccaaggcaattattcgccacaacccacccactgttttttctgtgcagatagaggctataatgaatgacttcattcaactggaaccacaatccaatttatttgaagcagagactatggtggaaggtacatacttccgacagttactgcagggtgccggctaatatgacttcgtttttctccagagtgtctctaatgtataaaattggcatgcataaagcaaatttgtaaatagtagcatggtcgtatcgtttttttatcgagctatttctttgtgcatcgacatttgtggctgtagcttcattcttgcactatgaggaagtaaccaggcttcatgaagatgtggttccattatttatatgataatagcctgtgctacaatttttctgctctaatattaaagatctatcattcgtttaggtacccttgatggattcacatttgattcagatgaggagggtgacaaactctatgaaccacaggctaatcaaaacgatctgaataataacgaagatgaaggtcaacctaaggcaaagaccaaaaggaaagcagagaaaacaacggtgtgttttcttgactctgataactaacctgcaactatgaatagctagaatccggatagttgtgatgtacagaggtttcgaattcatggtgcttcagatttacagtgattgcagattctgtattggatttgtttacagtgattctgtattgcagatttagcagtagtgctgttcttattttttacgcttccttggtgttgccatctttgatgaagtaagcatttcacaaaaccataacaaaaaaatgcagtacaacatgctaccatcaagtttgtggtaaatttgtcgagacaaccagtactccagattttggcttgctgtatgtatgaagcctcgcttgcttctacctgctagcgtgttgcaattctctcatagtagcccttacaggtcacaacttgatcttatgtaactacaaaagatttatttacttggaacaatgcttgtcgcaacatcatagtgcacctgcctgatggaggattctaatctgtttcccgtgacctgcaggggaaggcaccgaagaaggcgaaggttgcaggaaagggccctaaaaagggcacgaggaaaacccaacctgcgaagagaggtaggaaggctaagaaatgatgacatgttgatttcctcggataagaagaaaaagtctattgagaacctggatagctggcaacaaagatgtgaatttttcaacgcatagtcatggctgtgaggcgcgtcgtcagttcaacatcatgcagtacttgttttagagagagagaacatgtaaagctgtaaacgttgttgtgtactctatgagcgttcagctttggatcattgaaaagaccgagatgttcacgtggaggcgaactgacttctctattttttttcacaaa

SEQ ID NO: 212 - DNA, 6973 bp, Zea Mays; identical to SEQ ID NO: 211

SEQ ID NO: 213 - DNA, 7009 bp, Zea Mays
tccctggggccagcctcgtcaactccgcttccggttctggcccattggcgttgcttcacatcgacgcgcctgcgccgccggtccgccgcgccttcccctcccttctcccccgcgtgccctcctattccttctctgcggcggcgtggggagctgcatctgccttcgtctggaggagtgggaagaagcgctgccgaaggggtgatttacgaagccagagagcggctgggagcaagagtgcctgggactgggagttgaagctagagaggctagttgcttgtttggtgcgctgccaaaccgccctcaacatctgacccgtctctccctcacttccacggttccagcgagcggcgcaaccgcgcaactgagcagctagcatgggggacgaagaagatgatcctgactggctccgcgcgtttcaggtaccaactcgcttcatctccctcctctgccacatctccacttgaggtctccatggctaaatcgtggcatctgcggcgttaagcaagttttcctcctcttggagcaaaatcttttgttccggatgcaagatgccacctcttgccttagatttccacttcacttctaaatcccgcccttgaacctctagcgaaataggtcagagctcaggctgcagtgcgctaactaaaccctggaattctgaatttcggtttgcttgtggtggggaaaaaaaatcagcttctgccttaagctttccagaattgtttttttgttccaaaacctatacttcagagttcagatagctattatgtagcagttaccacttatcatatggattcaaacattttttgggagcaggcaccaactgtggcacctgtgatgctttcttctggttcagatacctcccctgaagctagtcctacaagaaccagtacatctagaaaacaaaacaagggagagaagcacgctagtccagatcatgcacgtgatagagatggtgcttcacaaaataaaaacaaaatctcagcagctactagaagaaaaaaccttgtcagtaaaaaaggtagaactaacgtacctgcttttttttagtactataaagattctgaggcacgactgcttaaggtcttgatccgtatttgtcacatggttgcttattgattcttttgacaaatatgcagaggggtcaactatggatgaaaaacaagctaatactcctagacgcttggtatggattttgagtgttgttttagattccctgtctccgattcatgatatcttggtaactaggctggtattgtgttgttgatttatccaataaaaacgataacatagcactatgtaattcctactgtactattagagacttgggctactagtttggccatcaatgagactgcaggtgtcattttattgtatagattaactgtacctgtttgtaatgttcgatttatattgtgatattagtgatcagacactgcaagtgttatgctttgttttaaattcactatgtcatagtagttgtaagctggtcctataatttgtagttaattttgacacataatattttttgtagactccaaagaaggatatggtaacactttcatctggttctgatgcttcaccgggaaacagcctttcgagggcccatgaagataaccatgaagagggctcacttagcactgccaagagaaagaatgctcaacaaactaagactaaaaaaacaaaggatgctggaacaaaaactggtgcagaccaagcagggagtaaggcactttaatatgacttccatttcagttgatacttgactcagatttggaatgacatgtacatgttatattgtttcatgattcaacatcaagatggagatgctgaggatgatgtgcaagataaactcacagggaactctgtaaagtgccaactcacccatctctccattttattctttttgctccttcaaatttggatgtgaaactctaggcctttagctattttcagttgtatatctgcagctctttgatggagtttatgctcctctaaatgccaggtctcccagaggttaccattaatatttccagataaagttcaacgttcaaaggtatactcaactctaagaggcactgcttatatggagatcactctcatttaaactttctacatttgcgataaaatgttatcaacatgcctgtgatctctcccctgattatatttatattcttattctcagaagaaatgttttagcattgctgtgtaaggaatgtgctatatagtgtgtagacttataatcaagacatgacatagatacttgtttgtgtatgtgtatgttcacttggagatagtaataatttaacaatgggatcatgaatgatttcaagtcgggcgacttgctagtgatacacctgggcgaccaggcgactaatcgcgattaggacgacgactaagtcgactaatcgggtcctagtcgacctggtcgtccctacagcgctcctgcatatttgcaggaactatgtatataatattgatatatatagcaatatagcatatagaaagcaataccaaacataagtacataacaattatgaatactggaactggacaattcagatttcagaacatgaacatcagtcactaactcaattatatatagcaatatagcatataggaagtaatactaattaccaaacatagcaaatatgaatactggaagacagaattcagattgcaggtttcagaacatgaacaattgaacatcagttactactcagtagtcactaactcactaattcatatgatgcagagttgcagacttactagttactacataaatgccaagtacatacttactattgacctaaactaggagtccagggcaactaatcgcccccacccaaattggacgactaatcgtgtttagtcgacgactaatcagacgaccggacgattagtcgagcagatcgggtcggcctccctagtcgtgctaacagaaccgactagcccgactaatcgcgattagtcggacgacttgaaatcacttgtactaaaacacaatagccacacatcctttttttctctgcttgaacaatgcatgacggcatgagagctgcattttatttccttaatcaatagaggaaaaatgattaacttgcaactgttcacccaatgtgaaatctgaaaataggaaaatgaaaaattaatgtgccacaaagcaatttaaaagacgacaacaacaacacaatgggtagaagcaaaaaggccttgagttggttaggtggcttgagtagcgtcctaaggttctaggtttaactccctgtaggagtgtaggagtaaattttcagactgggacaagcacatgtctaaggccgaccctagtcatggtcattctcccatgggctacaacaccgctgtgtatgggtatggcaagggttcgggagttttctcgacatacatgggtcttctttttattgcaatgcccctacaacgcaattttattgatttaaaaaagatgacagagaaataatacaagaaagacaaatttaaagaaacaaagaaggatagaggggataaagctagtgagagtttagccataaagtaaccctgaatttaagagaggagctaaatctaagcatttgaagcttcatcatgtcgttgaagcaactccgccaagaggagggagcaagattcctgaagataaactcatttctatgcttccagatgttctaggcaactaaaggcaaaatttccatgaagaaactgtggccgaacgcactcttgacaacctcaatcatcgtgaaaaaaatgcagatcttgattccaccgaattcccacataatttcaacattctgagcagaaagggcaatcaaacagaaggtggtatgttgtctcataattgagctcacaaaggatgcaattgacgttaccgccagaagtcagaaagccttccttctaagaaggttctttgagttagttctatccttgaagactaggcagacaaaaatcttgattttcttacgaactttggactgccagacccaattgaaaggggatggtggttgattggatctgaaatttaaattatagaacttggaagaactgaaattggcattggcccaaggatatatccaactgtctttgccctccctagaattttacatttggccaataatctcacagaaggcttgatattcttcagtggcttgaggagagaggagtatgaaagttatcttccagattcatattgtcaagaaattcctgaagagaacattctttctttctggcgaacgaaaagaggcaagggaaggaatgtttgggggaattattgttccaaacattctgccaaggaggatggtcctttcatccccaacccgaggcatagcatggcctctaaagagatccaccaatctgaaaacatctttccaccaaaaggagcctttttcaatagagccatgagggacccggctcgaagtatagtatgagctccaaacaagattcagccaagggatatcttgcctgccatagagtttatgcaagaatttcatcagaagagctatattctgaattttcaagtcgagcactcccagaccacccttattcttaggacatgtcactttatcccaagcaatgaggggatttcgatgagcattatcattattacctctccagggacaatcccttctcacagcctgggggctgtgttgcttcccacgggccaagttctttcacacaatgggataaaaagctccagcctacttaactaacaatatctcgatctcaagagcttcggcagtgtaccaaagagccatgtacttgtggttataatttctgaaatgtgtatctgtatttgtgtgttaaatggaactgtgaagaactagactctggataataacttggtgaatctatcattccctgttatcccgtaacgtattatacgtatacctgcaacattctgacttcatatccaaaattttattttatttatatttcccaacttatgatcattgttctgtttgtttgttttctttctaggcattgattgaatgtgatggtgactcgatagatttaagtggagatattggtgcggttgggaggatagtagtttcaaatggtcctactgcaaaacaggatttgttgttggacctgaaaggtactatcaagtaatttatcattttgtgtacttcattggatactgaattgtaatgatgtatctgtcaaaggatatccaaggccagatatcagtactgaagctttgcttaagcatttaaaccagccctgttttgtcttaaaccttgatatgtgcaatattccaagacttgagcatcttatttgttctttctaactcacacaggaacaatatacaaaacaactatagttccatccaggacattttgtgttgtaagttatgttccaaacccaagtagagatttattgttttgtgatggtgttttaaccctcgatgtattttcctttcaggtgagtgtgggacaatcagaagcaaaggttagctatccactgtcgatttacacatagcatttagtgtactatttctgcttgttaattgggttacgtgttcaatttctcaattccacttccattccaaggcaattattcgccacaacccacccactgttttttctgtgcagatagaggctataatgaatgacttcattcaactggaaccacaatccaatttatttgaagcagagactatggtggaaggtacatacttccgacagttactgcagggtgccggctaatatgacttcgtttttctccagagtgtctctaatgtataaaattggcatgcataaagcaaatttgtaaatagtagcatggtcgtatcgtttttttatcgagctatttctttgtgcatcgacatttgtggctgtagcttcattcttgcactatgaggaagtaaccaggcttcatgaagatgtggttccattatttatatgataatagcctgtgctacaatttttctgctctaatattaaagatctatcattcgtttaggtacccttgatggattcacatttgattcagatgaggagggtgacaaactctatgaaccacaggctaatcaaaacgatctgaataataacgaagatgaaggtcaacctaaggcaaagaccaaaaggaaagcagagaaaacaacggtgtgttttcttgactctgataactaacctgcaactatgaatagctagaatccggatagttgtgatgtacagaggtttcgaattcatggtgcttcagatttacagtgattgcagattctgtattggatttgtttacagtgattctgtattgcagatttagcagtagtgctgttcttattttttacgcttccttggtgttgccatctttgatgaagtaagcatttcacaaaaccataacaaaaaaatgcagtacaacatgctaccatcaagtttgtggtaaatttgtcgagacaaccagtactccagattttggcttgctgtatgtatgaagcctcgcttgcttctacctgctagcgtgttgcaattctctcatagtagcccttacaggtcacaacttgatcttatgtaactacaaaagatttatttacttggaacaatgcttgtcgcaacatcatagtgcacctgcctgatggaggattctaatctgtttcccgtgacctgcaggggaaggcaccgaagaaggcgaaggttgcaggaaagggccctaaaaagggcacgaggaaaacccaacctgcgaagagaggtaggaaggctaagaaatgatgacatgttgatttcctcggataagaagaaaaagtctattgagaacctggatagctggcaacaaagatgtgaatttttcaacgcatagtcatggctgtgaggcgcgtcgtcagttcaacatcatgcagtacttgttttagagagagagaacatgtaaagctgtaaacgttgttgtgtactctatgagcgttcagctttggatcattgaaaagaccgagatgttcacgtggaggcgaactgacttctctattttttttcacaaattaaaatctatcagtaaggctttgttcgtttatgcc

SEQ ID NO: 214 - DNA, 485 bp, Zea Mays; identical to SEQ ID NO: 39

SEQ ID NO: 215 - DNA, 3083 bp, Zea Mays
atggcagacctcccaccctctaagccagcccttccctctcaccctctaacccagtccttcccacccagttctgatgccccctcccacctcagcccctcgccggcattctccccgaactcggcgtccacacccacttttagccaggcgttagaacctagtcacagtggtgtatcttctcaggtaggacggtccaaattccagaggtggagcgacggaggtggtggtccattttccggtgagccctgttcctataaagatgctacactcatccagttgagtgcagtgccatcctctccttctcggggatcacagttgaggtctgcaaaggaggtggtggtccggggtcacgtcgaggacctccggcaggcggtctctgggcgacgtcaagaaggtctggtgtgtcattccctacccccgtctcctcggcggtaggaagtcgacgggtggcaaaccgttgataggcggcgtgggcggcggtttgagcaagctccgcgtcgtccggtggacctccgtgggaagtgtttcaactgtctgtccagcaaccactttgttgctgtgtgcagacgccctactcgctgtttccgctgtcgtcttcttgggcatcaagcaaggaggtgtccctctcttctcccggtagagaaagggacgtctggaaagccaccaagtgtgcaaggcgggcgtgttcaggtttggcagcggctgggtccaccggttccatcctctgtgctcaatcataggatgtctgtgtggcaaagaattggccctcagctgccgccgtcgaagttttctcattctccggcagcagaggcaagcttggtggagagcaatatctcgagtcattctggtaagaagaagaggaggcgggccaaatgtcataaggaggtttcttggcagtccacagcgccggtgggtgccgcttcgaccttggagccctcgccaggagtagggacgcagtcgagagtgaagacctgcgtgcttgagttctccactgctatggctcgggaggaggcggctcttcgccgggctttattcgtctctattgttggcagcaggccggagatcagtggagctgaagtgcgggatgaagtggctcgggcttttggaattgacgttaattcaatatcgattcatcagtccttgccagaagatttcctattgttgttaccggatgaaagttcggctgatagagtctttagcggaggaaaattgtttaggggccctcttttcaatcttcaattcagacggtggtcgcggttggctcatgctgaggcggctaggttgccagcactggtggaagtcgaggttcatggcatccctgcccacgcatgggatcgttctacggcggagtatctgctccgtgactcttgcattatcacagacattcatccgagcacgtcattgaagaatgatctgtcttccttcaggctttgtgcatggtgttcgaacacagatttgttccctcggtcgatgaagctcctcattgttgagccggggacggatgtgcacgagaaaagatgtctttcctatgatattgaggtggctgttactgctgtgatggttccgacgaatttcgacccccctccagctcatttcccttgcggctgatggacgggatcagcatgaggatggcggcgggaggcattcggacgactccaattctccacgtccggacgacgggcggcttcagcgcccaattttccagcgtctgggcccgaggggacagtcaacgtctggtggccatggtgctgcgttccagcgatgtgccctctcggacgcgggcctggctgaaggaatcgaggtggtggcctcccaacgcgcctgctggacggatctcctttatcgctgacgattggcgcaggagccgaggaggaccttgctgcggggatcgaggaggtgcgacggctgcattgccccctccctttactgctggttgctgcgggggtcgaggaggtgcctccccctgtgcggcggctggctgttaattctgtggcgggagtcgaggaggtggcctcttcaatgggacgagcggtccattctccttcatggttggcggcaggcacaggaaccgaggcgcacattgggagaatgctggcggccgacataggaaccgagacgcactctgggggaatgctggtggtcagcataggagccgaggcacacactgggagcatggtggtcgttcctgccagggaggtgttggctgtccatatggaactcacggcagcagacatgggcacaggtcccgggacagactgcgcaaaggttggccctgtgggctgtgctgttgatgctccagttgtgcaacagccgcagatggatgggcacggggggccatgtggacaaggttggctgggtcgctgaaaccgcttgggtcgggctctccccgacagaggtttgtcgggttgcagaggctgaccaagaccgtttcgccccgcaacagtttcaatgtcgggatcgagttggtcccccggctgacctcaactcaatctttggttgggacgtcggaggcggacaggaactctcccgctggaatgtcacttgatgcttaggtccttgagagccccagactgaaggtgtactcaagattgaaaaagggcagacttcagatacctgcatcggtttcatcccagatggaggtgtcggcaccagttttggatctggtacctgctggtgtttcttctcagttggaggaggcgacccccgttatgaaactggtggctaatatcacaagggacattgactgcttgcttccgcaacctccaattcaaaaaagaagaactaaacagcttccgccagattttgtcccacgtcacagtagtcgcttgtcaaagaaaagggaaggcttaaattcaacagtcagacaagtccaggcggagctcatgttgaagttgaacgtcacaaactcacaggtggctgtgactgatgaaatgctggaggaatttggacagctgtttgacaaacccctttccaactctcacatcaaggccctggcagctttgtttggatggccggtcccagataatgtgcaagaatgcttggatgttcctttgcttagggagttaagcattgaaacgtgtgcttga

SEQ ID NO: 216 - DNA, 2589 bp, Zea Mays
atgaagttaagtaagcatattgtatattagcttcgtgtaaacaaatcatttgaactcaaacttgctatgatctaatgttagtaaattccttataggtgcttcattgaaagatgctgctataactatttttatcttcggtgcagggatgacttgatagaattttttttccgttgcggctgtacgcatgacctgtaaactactggaaactcagaatttggtatggttagattttttcctatctatggcttcgttaacagccaatgcacaaaatgttaatgtgacaatagtgcatagctgtaaaatttttctgtaattcagtgattggaagttagtaatcgacacaacattcactattgtcatattgtgcttttgcccccgtcattttgtccttccatagttgcacagtgctgctttttcattacagccatagtgtgatctatacttaagcttcatgtttagggtttctgcagcacagttgttgtcaggacagcggtttatggagccatggtctcactagatatgggaaacaatatatttcaatagtcctgctttcttcctcgttaatatcttgtgcaggatacataccagttctctatgcaacattttggaaatacgcctatatgagagtttgtaaaaatattccatctgaactgccagatcctacatcttcattttttaacagactgacaagttctctagaacctgttgatttcacaggtcctctcttcagtggcttctttgatacttgtgtcctaaaatgggagcatatattgtttatctctctcagtggtcttttgtcaagctagagttatgatcttgtgcagatgtgaattgtttttctactctagtaaagttggtttaaatcagggccaggtacactaaatggttttgttgttgatacaactactttactttttgtcctaagtgtagttgagctcccagctttattgaattgaacttttaaacttcttgaaataaacatatagctcctattccttttaaggcacattacaatgtcagagcctacaatatttaaatcacttgcaccagatcccttaattccttcagacacctcatgatttgtacctccctgtatagtggtactgtgtatgcttccttttgttgtgtgacctaccaacaaactagatagatgtaaatatgtccgggtttattctacaaattttattatgttgacttgaattaaatttttaggagaggatcttttggtgattgctgctgatcaaccatttcgcttcccttccacatttacatttgtggtcagagcattctcaggtttcaatgtctaataatctacatgtttacaaggaaattgttattatactgtgtactcagactgtctccttttttgtgcagttctagatggtattaggaaaggccttgatcctaggtttcatattacagagattgctaagccgtgagtactttttgcattactagcatctgaatacttattcaaaaacatgcaaagcttgcacatcttcacatatccaattgtttcaacaattggatatgtgagttcagaattattaatatattgcgtttttctatgttacttcatgctgaaccatgaaaagataaaggcaaacttgtctgctggatgatactgtcactaagtgcatgcaaattcagttagcctgcactggaattgttacaagaaaattgagagagggtgcctgcacatttgatgcaagaaatctgatcaagtcatcaagagaaacaagaaaattgaggtagggtagcttcctccctttccctccccctttatttaggccggagctgttgcagcagctgcaacagcacgtgcccagcggcggttcctctgttctcgtggttggcctgattcggattgtgtgtaagcaagggttggcattgtttgcaggtgcggtgcagggacaacgagctatgcagcgccgccggcgccaaggtggtggtgacggaccaagcgcggatgtcgaaccgcacagccctggtgctgagcgccgcggcgtacgcggccatagccagcgccggcaaggccgcgcgcctcagggaccggcgcgttgtcgacgtcgagtacaagaggtacttgggcgcatcgacaccgacactctgcttcggtcccgcgggccgatgatgcagagttctttactggtgggagaaggatcaagagattgattttgtgtatactacgctcagggtaccctacgagtacgcgaaggaccgcaacctgtcgatacgcgtggaggagaagatccggccgccaagcaacctgtccatcaggatcctgtaccagggcggccagaccgacatcgtcgccgtcgacgtcgccaccgtaagctaacaggcggatgccgtcgtcgtgacgaggaggtgaggtcagagacagacctcgcacagccaaaccggaaagaaatgtttggtagatcaaaagcaaatggcgccctaacatttccagaaattactattttgtttcttaacgcttgtacgcaaacctagaaattactgttttgtttcttaaacaaatgccattctacaaattttgcatcgtccccgtagggcgcccgtaagggcgccgcctgttctagttag

SEQ ID NO: 217 - DNA, 1707 bp, Zea Mays
gcagcaacaccgcccccggcctcgctttgcagccccctccctccaccgcctcctccacgccctagcgctccggcccccgccccgagctcgtcgtggccggctgcgctgcggtgcccgcacctgtgggggcgtgcgggccggtggtgaaacgacccgcgacctcggtgcctctcgacgtctgcccgcttcctcgccggcgccattttgttcgtacgcctcctgccccccagctcttgctcgctagtagcttgcggctgtggtttgctcggttgctctctagtacttgagaggagggtatcgggcttgtgggtttcgcttgcttctcctctgtggctctgtgctttagcgcccagatctagtgccctaaatggatgtagaggtgttgcttcacctattaactggcaacatttcgactgtctgattggaatcaaccaagtcgcgacttcccgctactcccgtgcttcagattgcgcgcttgggttcccgtatgggcgcggaagcggaacagtggaacagggcgtgttgtcgagttggtatgcgtggaagcggaacagtgaaacaggccgtgctcgtctgtgcaccttgtgactgttaattctacacggctatgaataaatgtcacactgctgagtgcagactctgaaatctgagtgtactttacagtttattgactagatgtgcacgtacggatagattagtgctgtagcttttcattcggtcggccacattttctatgatgtttagatgtagatgagagtcatacgggggcgtggtgaaccaaatcaatttttggtggcggtgtggtcccaaattccgcctcatactactttgacccaaaccaaacatatctaagtgctctgtctctgtgtacatccatccgatgtggacatatgtcttcagatgccatgcctattagaaataaataaaagtactgcagtaggtcagatcagcatagcttcgtgcaagataactctctcccttattgttttgacatactgcagccatcataaatttgttgttcagcctcttactttctgcctgaccctttttaacacatctttcattgcattattaggtctaaatcccctgtgataagcaccactgctcgtgatgcattcttcggaaaataaactgggttggaatgagacctctatggggttggttcctgtaccaaaaagaccagctagacctgatgcttcccaccaatgcaaatctgattcctttatgaagcgatcaccaaggaaagttagaaatgctactctggcaaaaagcataaagagcaaataccactatagtcccctcaaacagcggaagggttcagattctgttcctgggaaaatcgtaacaggactaaccgcaaggaaaaagaagaaaaggaaaatccaaattacagacgaggcaactcgtttggaacgaagagcgagatattttctaatcaagataaaactggagcagaatttgctagatgcttactctggagatggatggaatgggcaaaggtgcattccctgctctttctgctgtaatctgctggtgtaaagaaagttttcaaatctatatacatccttgtagagtcaatgcattcttttgaactttggaacctgaaaaatgctgtcttatcttgtcacgatgaatagaggaaagttcacggaaagtgtaatgtagcttttaaggcttgcaacaagatgcttattattttgaaactta

SEQ ID NO: 218 - DNA, 13119 bp, Zea Mays
gcagcaacaccgcccccggcctcgctttgcagccccctccctccaccgcctcctccacgccctagcgctccggcccccgccccgagctcgtcgtggccggctgcgctgcggtgcccgcacctgtgggggcgtgcgggccggtggtgaaacgacccgcgacctcggtgcctctcgacgtctgcccgcttcctcgccggcgccattttgttcgtacgcctcctgccccccagctcttgctcgctagtagcttgcggctgtggtttgctcggttgctctctagtacttgagaggagggtatcgggcttgtgggtttcgcttgcttctcctctgtggctctgtgctttagcgcccagatctagtgccctaaatggatgtagaggtgttgcttcacctattaactggcaacatttcgactgtctgattggaatcaaccaagtcgcgacttcccgctactcccgtgcttcagattgcgcgcttgggttcccgtatgggcgcggaagcggaacagtggaacagggcgtgttgtcgagttggtatgcgtggaagcggaacagtgaaacaggccgtgctcgtctgtgcaccttgtgactgttaattctacacggctatgaataaatgtcacactgctgagtgcagactctgaaatctgagtgtactttacagtttattgactagatgtgcacgtacggatagattagtgctgtagcttttcattcggtcggccacattttctatgatgtttagatgtagatgagagtcatacgggggcgtggtgaaccaaatcaatttttggtggcggtgtggtcccaaattccgcctcatactactttgacccaaaccaaacatatctaagtgctctgtctctgtgtacatccatccgatgtggacatatgtcttcagatgccatgcctattagaaataaataaaagtactgcagtaggtcagatcagcatagcttcgtgcaagataactctctcccttattgttttgacatactgcagccatcataaatttgttgttcagcctcttactttctgcctgaccctttttaacacatctttcattgcattattaggtctaaatcccctgtgataagcaccactgctcgtgatgcattcttcggaaaataaactgggttggaatgagacctctatggggttggttcctgtaccaaaaagaccagctagacctgatgcttcccaccaatgcaaatctgattcctttatgaagcgatcaccaaggaaagttagaaatgctactctggcaaaaagcataaagagcaaataccactatagtcccctcaaacagcggaagggttcagattctgttcctgggaaaatcgtaacaggactaaccgcaaggaaaaagaagaaaaggaaaatccaaattacagacgaggcaactcgtttggaacgaagagcgagatattttctaatcaagataaaactggagcagaatttgctagatgcttactctggagatggatggaatgggcaaaggtgcattccctgctctttctgctgtaatctgctggtgtaaagaaagttttcaaatctatatacatccttgtagagtcaatgcattcttttgaactttggaacctgaaaaatgctgtcttatcttgtcacgatgaatagaggaaagttcacggaaagtgtaatgtagcttttaaggcttgcaacaagatgcttattattttgaaacttattcatatgagctttatgacgtcccacgaagattaggtgtatgtggacaattttcaacaaatacacgttttatgttttttaaacttccttaattatattaatatagattttcatagtctatgaacatttgggttgatgcaattgatgtctatttcatggaatgaaagtgctgtgtggtaccttttattgactgggttagtgagataactcttattttccttcctattgttcggataggttcatgttaacaggtcatattgtaactaaccttgattagattagataatagcccccttgggtactgtagcatatataggcagaccctaatatatgggccttaacaccccctgtcaaactcaaggcggaagtggaggatttgaagcattgagtttgattagatgaaactgatgttgtgccttagtttgtgcttttgtgaaaaaatccgcaagctgtaattctgagggcacatattgaagatcaatggtcttctggtgacaatgagatctagtgaatgagacatcaacaccaatgtgttttgtgagttcacgcttcactggatcatgacaaatttgtatagctccagtattgtcacagcgaagaagtgtaggcgagtcacaagaaacgcctagatcagccaagagccaacgaatccagataatctcagcagtagtagtagccagggctcgaagttctgcttcagtactagatctagatacatcggcttgcttcttggatttccaagcaacaggggatgatccaagaagaatacaataaccagtgatggagcgacgatctgtaggatcactggcccaggtagcatcagagtaagcatgaagctgaagtggagaatttgagtcataaaataaacattgtgtttttgtcccccgtaaatatctaagcacacgaagtaagtgcccataatgaactgatgtaggagcagagacaaactgactcaagatctgaaccgcatgagcaatatctggcctggtgacagtaaggtaaaccaagctgccaacaagatgtctatatcgagatggatcttccaaaggtgtcccatcagtcgaatgaagagataagtgaagatccataggtgtggcaacactgcgagtatcactaagaccagaacgatcaagaaggtcttgtatgtacttagcctgagaaagataaataccatcttgagtctgcaaaacctcaatgcccaagaaataactgagtgcccccaagtcagacatttgaaattccttactcagagacgacttcacatgagcaatatggtctagatcatcgcctgtaatcaacatgtcatcaacatatagtaatagcaacgtgcgtcctcgtgaagaaacatgaatgaacaatgcaggatcatgatcactagaatagaaaccacaagccttgatgacagaaacaaatctctcaaaccaagcacgaggagcttgtttgagaccatacaaggctcgacggagacgacatacatgccctgatggaacttctatcccaggaggtggatacatatagacttcctcgtgtaaatcaccatgaagaaaaacatttttgacatccatctgagagatagtccaagaagatgaggctgcaacagcaagtaaagctcggacagtagtcagatgggccacaggtgcaaaagtctcatcataatcaataccctgtgtctgttgaaaacctctggcgacaagacgagctttatatcgctcaatagacccatcagatttggttttaaccttgaagacccatttgcacgtgataggtaccgcaccagcaggtaacggaacaacatcccatgtacacgtgcgatgaagggcatttaattcatcagtcatagcaagctgccactcaggtataccagaagcctctttataagatgatggttcagcaatgactgccccagcacgggaaaacccataacggtctggagctgcaatagtgccacgatcacgaagatgatatccctgattaaaaacaacatgagagtcatcattgttagtacaagtatcaacaacaggatcatcatcaggactggtcgtgggagtagagcgaggacgacgaatgtaagtctgagtgacaggtggtttggaagagtaagactgagagggtgtggaagtggaaggtggtgtgatgggaataaggacatctggggtagaaacagtaggtggtgatactgatgaattttcagaaatgggaggaaggctcatgaaggaggtagactctgtggaataaaaagaagaatgagtggaagaattgtaaaagaagggacgattttcattgaaactcacatctcgagaaatgcgcatgcgacgagaagatgaatcataacatcgatagcctttatgttcagggctgtatccaagaaaaacacactcaacagattgagcagtcaatttagtacgttcacgaggtgataataggacataacacgtacatccaaaaactcgaaggtggtcatatcgtggaggagttccgaaaagaacttcaccaggtgttttgccagagagtttggatgacggttgtctattgatgagataaaccgcagtagaaactgcttcaccccaaaaatgtgaagggacaaaagaagatatcaacaaagtgcgagcagtttctataatgtgacgatgtttgcgttcagccacaccgttctgtgcatgagcaccagggcaagaaagttgagcaagagtaccctttgaagtcaaaaactggcgaaaattatcagataaatattcaccacccgaatcagaacgaaagattttaatgtgagtggaaaattgagtgtgaatcatacgagcaaaggttttataaatagaaatcagctcagagcggcgtttcataaaataaatccaagtgtagcgagaatgatcatcaataaaaatgacataatatttatatccaccttttgacacaaaaggtgcaggaccccaaatatcagagtgaaccaaatcaaagggtttaacagaatgagaattactagtaaaatatggaagttgtatttgttttccaagatgacaacccttacaatgaaaatcagactcaaccgaagtatgacctaagcaacctgactttattagtgtagacaatctagatccacacaaatgacctagacgatgatgccactgggcaaaagacgcaacagaagcaagggtagctgaaagcatatgcgctggagatgtaggcaaagaaggaagccgcaaagagtccaagatgtagaggcgaggagcagctctacggcgacggccagtcccaatcacttcccctgtgcgaaggtcctgtacaaaacaagatgagtcatcaaatccgacaaagcaattatgatccgtaatttggcctacggaaagaagatccatagataactcagggacgaagaaaatattaggtactgtaaagtgcggatctgaaagagaacccttatgagtaatgtggcatacaataccatcagctgtctgcactgaagcaccatctgtgacaggtgtagtagaagccaactttgactgatcagaggtgacatgaaagaaagctcctgaatcaagtacccaggccgactctgaagtacaggcggacgaagtggcagcaacagcaactgagcctctattagatggtccttgaccacgaccgcgagcagcacgtcgtgcacggaaatcagtcaacttatcagggaacttgacaaagcaaagctcagatcgatgattggtcttgccacaatgatcacaaggcttaaaaatattcttaggtttctgggcagcagccaacacactgtgaggattaccaccagtagaggacagagaatgaagacgagtctcttcagcaagtaaatcagacaacgccttagccattgtgagagtgtcagaaccctgaagtaaacgagcacgaagagaatgaaactcggcccgaacacccataacaaatctgtaagttaagaacttctcaataaactgatgagccggacacggatcagcagtacaagctggcaccatagatgtcaaagcactcatcagacgatcaaaggctgagtagtactcatcaatgctcatatcattttgctcaataacatgtgtctgctgcatgagagtgtgtaatagagcaccactgtcctgaacaaaacgctccttcaaatgagaccagatggctttggcagttttaaatttagacaaactcataatcatagacggtttgacgctgttcaccatagcagtcatcactttaccatcattaagctgccatgttttgatatcagcagcattgcgacgatcatccgcaagtacgggtgccgcatcggtcaaatgaaagagtaatccatgtcctctgagtgcagtctcaacacagaaagcccactccggataattgtgtccatcaagagtgatattgaccacaatagcatttgtcgtcatattgaattcaatgaaaaacaggaagaacaggagactgaaaccaagcaaaccagaggaaccgcagctgacagcagtccgagttggacgagttgacgaaggtcttggtcgcggaagccgagttgatcagtctgcccgcaatggcagccaccggcgcacggcgcagatggcgacgaggcagggtgcagttgacggcgacgcagatccggatccgcagactgttgcggtgtgctgcaggcggacggctacagggcgcagtaggcggacgacgaaggacagcagcctggcgcagcactgctgggaacggcagcctggcgcagcactgctgggaactgcgccctggcgcagcaagcacggcggacagcagtggacagcactgctgggaactgcgccctggcgcagcaggcacgcggacagcagtggacagcggcgaccaggggcggacagcagtggacagcggcggccaggaagggtagattcgcgacggcggatgggcagcagccggatccgcgaggatggccgcggaacgggacgagatccgcgatggcggatgggcagcggcgcggatctggacgagggcggcgcagacgagctcgcagtccagcgaacgggcggcggccggatctgggcagcggcggcgcggatctggacgagggcggcgaacgggcggcgaccggatctgggcggcggcggcgcagacgagctcgcagcgacgggatccagcaaacgggcggtggccggatcagggcggcagcgggcgggatccgcgcagatgaggccgcaggcggtagggccgcgacggcggcggagaagaccgcgacggcggcaaaggggaccacgacggcggccggaaggagagatggtggctggaaaaaaaaatctaagaaaccctaatcgtgacctcctctgataccatgtaactaaccttgattagattagataatagcccccttgggtactgtagcatatatataggcagaccataatatatgggccttaacacatataacttttcttaaatcagttccacaacattgctgttatgtaatttgcttcctcgtttttttcagttgtttttatgtgctagtacagtaaagtacactaattatgttcaccttcccaagcagccgagagaaaataaagccagagaaggaactgcaacgtgccaggaaacaaatcataaaatgcaaaattgctatacgtgatatcatccgccaacttgatttgtatacttctactgggagtgttgatgacccactaatgcctacagatcagtccaccaatcccgaacatgtatgtatgttatcaagtgaaggtcagatgctctacttcattggatctatcaactgataaattgtcaatatttattttgctagaccatgtgctcaacatgcaagtctcatgaatcatttcccagcaataaaattatcttctgcaaagggccctgcaaaagggcatgtcatgagaaatgtttggaacctcccttaaacaaaagcggtaattatttctgttttacttccaaatgtgcggctttatatttgtttgacatggttatgtgttgagtttaaagcctaacagatttattttgaactctccacctcccttccctgaaaactttgtttcagcctttcatgctatcctttttgtgcttagtgtaataatctcgttacatgtgtatggcaaaacaatgcctattttgtttgcttaccggtaaaagttataaggatatattttttcatttcaaaaccagttgatcattgacagataaacagtaccttgacacgtcttacgctagatttatcccattccttactaaaaagttaccattctaagtccaggctgatttttggcaatatctgtgtttactttattttagagttataaattcatgtgccagacccatcagggctcaacaataatagctgaacactgtctagttcctctgttttgtaaacctattttagagttttgctttttggcttgtcactgcttaactttatagttttgttaattttctaccttctataactcttaaaaaatcccatgtgtaacaagttgagatttttgagctgtatgtttaccgcataggttgtacatggccagatggcctggatgtaaaaccagctaaactctgcagtttgaatgcacttgttgctgagctgcaattattatcacgataagtttgcttgtcatgattacaatatgtaatacaaacattgattggcaacaggcacataagtacataacctagcataattgtgccaataatctgaatgaacttgtgcagaaaaaaaaatgatattgcaaatttatggaattgcactcagcaaggtatatattacctcgggccaaaatcaacagtattagagtctagtgccaaactttaattggcaaagtttgtcatgatttgtatattcatgtagtcttttctgtgtaatagctttcatgttgtggtgttgtttggttcactttttgcttttgttttatatgtagtagacaaaacttgccaaactttaatagtgtggcatttatttcataggaactactacctttgaagtatcattactcctttgcatgtctgcttttgcaacagttctatgtagattctgttttgatgctgcagtggcatttattttaccgatgatacatttatctgtcttgttcttttcatcagtacttccaacaagtagccatgggtggctttgcaaattctgtttgtgcaaggtgaggattttagaaactattaatgcacatctagggacgagttttacagtgaagtgccactttgaagtaagtgtttatcattctcacacccatattatgattattttacttcagcatttttgtcactgtcaattctacttgctttctgtaggatatattcaaggaaactactgaactaatagactctgaggatgcactagatgaagattggctttctgagtattcaggtgatgaggactatgatcctgatgaaaatgaggccagtggcgactgtatggacagcggggagaagattatgtctgatgattccaatggttcaggaagccccctttattctccaaatgacgatattcctgacttcatatcagcagacttaaatgttgtggaagggttttgtcataccaatttagatttaggcattgatgccgttgaagatgattttgcacagatcctcacctaccaaaggccaagaagagatgttgattatagaaggcttaacgaggtatatttcaccagtacatattgttgttaccaatattgtaattcaaaacactggtaggaaatgttctgtagaagtcactcatcaattaagtgttgattacttattatcctgcacaggaaatgtttgggaaaataaccgggaatgaagaacagagcgaggacgaagattggggccatgaaaggagaaagaaaaggacacattcaggtgttgctggggataattctgttggtttcttgaacgttatatctgatgaaaagagccagaagaaggggagaaaacttttcaggattcctcctgcagctgttgaggtaattgatacttgaaaaatgatagactactttatagctgcatattatgattcatatatctatttgctgtcatgctgtgatacaaggccaactcatggttgtatttggatttgaattcgcttattgcgcactgccggcgactatggaactaccacttctaccttgttcagttgttcatggcttcacgcatgcttacaataacatcctctgatcttcaccgtgctaaaaacaggtacttcgcagagcttttgctgaaaatgagcttccaccccgggatgttaaagaaaatctctcaagagaattgggaatttcttttgaaaaggtattcagtgttggaatgctggattggataaatgttctcagctgtgtgttactgagtacttttatgtgttgattcacctgaaacttgctttatgctgttcaattactgtatggcaccgtggagtatagtgaagtccatatcacagttgtctttctttccatcaacaatgtatttggacagggcgtctaagaaatatggattgattaccattttttttcttcaaatcttaacatcagtaatcaatgtctgtcatccatttgcagattgataaatggttcaaaaatacacggtgtgctgctctcagagatcggaaggtttgatttatgtcccatggttattcatatgatctactgtttccgtcccaaaatagttgtcgctgtggtatttgtgccagtcaaactttgtttggctagacttttagaaaatattagcaacatttgtatctccaaataagtttattacgaaaatagattcaaagagctatctggtgatactaatcatgtactataaatattaattttttttgtatatatttggtcaaagttaaaaaatggttaactccttgaaaagcgagaacaacaactatttgggattgagagagtacatcatatcatttaatcaatagtattctcttgcatccaaagttgttacctgcttacctttgattcttggcccccaccccaccccaaaccaccacttctgttttctctctagaaacatttgcagcaggacgtaatagaagttaaaaaacccaacaatgtcagtgtatttatgctagtgaatatgtgttttctataagtgcacaagttacttaatatgtacagaatcattcattggcacgaactaaactttgatttaactgttatggctttgactattgcatatgcttttattctttgagtaaatttattgaaggacacagcaccaagttcttgtacttttcattcagcatatcttgtggttatatacttgacaacgttgacattggtgccatctttcaggctgaaggaaacagtcataatacagctcccagcaaaagctcaaaaaataaaggaaaagctggaatctcaggcaaggttgattcagcagacaatccatactttgttcacatctctgaaaccaccaaagtcctgctgtgtttgtgagcaaatgagaaaagtttgattctcagttgtctattgtcttaaggattcatgttggttataataatgccaggacaatggttagctccccaggtgagggaggtgctggccagggatcaaatcctagtggccaaaagaaaaaccccttgctgccaatccccaaaaggtagtggcagatcgcaggtctgtggcagctttagggctcgttcagttggcagcgggttggaggggattgagggggattaaatccccttctgttcaaaattgaataggaggggatttaatcccctccaatccactagcaaccgaacaagccctttagaccttgtttggatactctcgtatttagttcaatccacatgtataatgtattgagatggattgaagtgtaacttagtttaatttacacctcaatccacctcaatacatgtggatttggattgaagtgtaacttagtttaatttacactcaatccacctcaatacatgtggattgatgtaaatacgggagtatccaaataaggccttattgggatgatgaggccatggtttggtgcctttcttcatttttttgtcagtttattcttattggaacacaatgggcgggtctccgcacccccaccccaaccagacgagttctttaaataattccatgcaccaaaggtttatagtctgtgtgttacttgatcagttgatctataaagtataaatatcacctttacagattacttcatttgaaaatctcatttcaagtggccatgaactaaactgaagtatattttaagtttttttttctgttacactgaaatattttggtttcatgcggaaatttattgaaataaaagtgccaagttctctcttttttttcttcattttatcttgtgcatatagatatccaaatagagtgtattgttaatctctctcctgtcatgcagactggaaggaatggtcatgttactggtccctgcaataatttgagaacaaatgaagaaaaaacaggtatatcggggaagtttgattcaggagacaactcttgtttggttcccttctctgaagtcatcaatgtgcctacgcgattgccacacaactttgagatgaggaagatggaatcaactagaagtcctgcgaggctacacaataaaggagggttcctgtctgcaacagtccaaattaaggtagaaacgacacgatgctgactgcgtttagatcttatctaattttacgagggacttaattgtgtggcctcaacatgtttgcaggagagtacgttgttacccacaggcaagccttgttggcagtcagaaatgagccatccaacaactaatgaagtgagcacttcagcgcaagctactacttggatcgacgcgggggcgtgtgccgaggagcaagaacctactccttgggtggacatcggggtctcagactaccagcctttcctggatgtgatcgacgacatgtgcggacttgagtggaggctgcagagactgaaggagaacatgctctcatctagcatagacggccaaaccgccgccagtgagagtgacaaaagaaaccagaccgtggtgctagtgccaaccgccgagctcaaggaaaagctgccgcatgacggtttattcgggcattattgcccataggtcttatatacatagcggataaactgtacagagaaccaagaagaagaagaaaacaaaagggaaacagcaaacagacaggtgcccgcttacataccggtccatactgtcaggcactactctcctttcttgggcctcgacacgactaatactgtgctagtccagaacagatgagccatagccattacctgtgtgcctcccaggttcagttcatatgttgtatgtattaatgtatatcagaagagtcgtgcttagtagtagcaagaacctagtcctgatccagaccgtgaatctggatcatcttgtcctgtggttgtaccgtgcagaacagacagatgtcggctagtcgtttggttctgaagtaagaaactataagcatgcgtgattttggccc

SEQ ID NO: 219 - DNA, 13119 bp, Zea Mays; identical to SEQ ID NO: 218

SEQ ID NO: 220 - DNA, 13119 bp, Zea Mays; identical to SEQ ID NO: 218

SEQ ID NO: 221 - DNA, 4044 bp, Zea Mays
gaaccctttcttcctcctcatcccccaagccccaaccagctccaattccccccccccccccccccccccatacaatatcttttctctctcatcctccaaaggaccaagaagtaccatttctgctctctccattcgtctccaatcccaacacagcttctcaattcagttcagggaattctcccttttcttttgttttgctctagtgctcttggctgtttactccgcttcttatcctcttctctccacagaagaggagtgcatgtgcagcagctgtaaagacagtatttttttttcacctcatcttctcccaaggtgttgttggtgccccaggtggaggcaactgccaaagtgtttgggtttcttgaatgttaggcttttttggggaggaggaaagggcttgatcgattaggttgttcagccattcttgccccagtgttcttggattcatggtcgtggaattaatccaagggtagctggaggctggagctgctccatttcccttccgagaaaacgaaggcgaaggcgatcgtttgaacggttacagctgttgccgttgagccggtgcaatgtcgtcttcctgcatgccgacgggcctgcggctggacctggacatggtgaaggcggcggcgtcgccgggcgcgcactcgtcgccgctgcgcccggtgcactcgtcgccgtcgtcgacgctgtcggaggcgtccaacgcgtcgtcgtcggcgacgtccgtgtcgctgaagcgggcgcgcgcgccgcggaagcggccgaaccaggcgtacaacgaggccgccgcgctgctggcgtccatccacccctccgtcttccccgtcaagaagagccccaagacggcgccgccgcgcccgccgtcgtcgcggcagctctccgggctcgcggcggcgctcgacgcctcctcctccgacctcctcccgccgctccccgtcctcgccgactccgcattcctgctccgagacatacccgcgccgtcgccgctgccgcagccgcagagcccgtccgccgccaagaactgctcgtcgccggcccccgtgagcagcgcgttccgggacttccgcgacccggcgccgtcgccggcgagccccgacaccgtcgacgtcaacgagctcggcgagatcgacttcgacgacgacggcttcgacgccgagtccatcctcgacgtcgaggaggccgcggccgcggccgagggcctcgacggcatcatgggcagcctcaccgtcgagagcaacagcaccgccgccaccacgtccgatgactccatcctgtccagctccggcatccacccctacctcaggagcctcatggtggtcggcctcgccggcaggttcgagctcggcctcgggtcccggcacggcgctcggcccaacctcaaccgcgcactgaagcggcgggacgacgatggcgcctggtggatgtggccggcagtgccggtaaaggacctaacggttgcaccaccgacaccgccggcgtcaaacgccgcagtgtcacagccacagcccgccgccgctccggagaagaacaaaagcaagaagaagaaggtggtgaaggtggagaaggtcatgatgggggcgaagggaaaagaggagctgcttcccagcgcgaaatgcaaggaggaggaagctgatggcgacggcgacgctgaaagcgcgccggtgaaggcgccaaagaccgggctggggctgaagctggacgccgacgaggtgctcaaggcgtggtccgacagagggtccatgtttgccgagggaagcgcgccggagtcgccgacatcggtcgccgaagcgcgggtaagtgtaacaattgggtaccgtctgcatgcatctccagtgttctttcgtttaaaaatttggatttctaaacaaattttagatgtatagtaaaaaccacgcatagaaaatttgaagcaatctataatttgcggtgacaaggctcgcagtggtaaaaaaatctggaattgtgaattgcttccttcgaacaagtaaaccagagggactgtttatctaaatggatggtccctcgcataaagtactgtgcagtactgcactgctacgtatcagcgagtacacgtctttttcagaacatcagcggtactgcagtaacccgtagaaaaaaaagttatcgagataaaatattgagttttttatttaccggggaagaaaatatagaaaatagtgaaccttagacgcttagagtatgtcggatagtctttataaatttcactttctaaattatcatttggagagttatttacataaaaatcactttgtatatctttttagtctccaacatcttttctatatgttgtttatatttccaatcttcaacagcttttctatacattgtttgcgctctagagagtcattcatattttctatctttatcgtgagaaatctggaacaaaagaagactatatttggatagccatttaaataagttgttggatgatatttaaaaaaaaactctattcataaggaagaatatagatagtctcttgacgttgctcttaggtctcagcaagaacaatttttcaaatttggatgaactactttctgctctattagttcaatgtaattctgttagataagggaataatccaaaccagccattctatttggttatatatggctagttaaactcaatcattcaacagtggaccacagacagtagagcctggagatctggtgccaagcacaacaacaggtctgcctgtcctgtcctctagaaaagggtcgttttgggctcggttttttggtggcccttgggccaaccaaacgatagagcaatcgcaacaaacgctgctagccccaactcggttggcttggcggccttggccgttctgcaatttgctctgtggccacatgcatgcgtatttggagcctgtcactcatacaagacagccagctctttatatagtatgggcataccaagcatgtggtttccattagagacttctcgttgacgacgacggtgtaataacagccttgcaaagttcctcctgaatatcttaatttgcacgccatctgaagctctgaaaccgaggaatgggaactctctctcttactgacgatcactgcgttgcattgacccttgtcatcacaggccaagctctcagacatggacctgtttccggagaacgaagccggcgccggcgccggcggcgtcagggaggccagcgtgctgcggtacaaggagaagaggcgcacccggctcttctccaagaagatccggtaccaggtgcgcaaggtgaacgccgactgccggcctcggatgaaggcaagcaccactagaactgattagaaagagcgtaaaagatgtgtccgtaaggccccagaaaacactcaacaccaaagggagagaaaaaaaaaagttcatcctgatgacgcagtattgcagttcgtcgtaaaggccgaaggttctgaggcgctgacgtgctctgtgtttctctgttcctgctgtggtttcttgcaggggaggtttgttaggagcccgtctcttcttcggcaagccctggaggaagagagctagctagacagacacaggcagtggtcctcgctagccttttcttttcttttagttttttttttcaaagcaactttttgttcctctagttcctcgttagctaagactaagagatgtgagtgagaaattttcccagttttttttttgtttcatcggagttttgctctggagaggataggtgaggatggctttagcgtgggttgtcatggcatggtggtcacatagtttgtctcaggtttacaatgtgagaggtaaaggaaggaaataaagcggtgttagaagaacataccgtcatacagcaagcagctccagatgatgggttctgttgtgcttttactgctccagaatatcaatcgcgttgctctgtaacatccattgcgaagaagaaaacgacgagtacaaattagcacggattgttatgcgctagtaagtagcgcgtaagtatttttcttctttaatcagctgacagcatctgctgttcagcggtaaaagtatctgcagtgcggtcactgccaaaat

SEQ ID NO: 222 - DNA, 5306 bp, Zea Mays
tcccctctcccggtcctccccacccccatccctcctcacggtcacggcacgggactcgcctccccccctcctcttcctcccctcccgcccacggctggaggtgctcacagcgagcggagcggaggcgagggattcggccgcgcgcatggcgacgcctctctgaccgaagctgctccacccactcggccaggcgcgccgtcctctcctctcccctccccttatcctctcgtgtgagtggaaatcttccgcgttttctccttcgttcgctttctgtctgtattgtctgctatggtttgcgctccgacgaccgaccgaccgtccgttcgtgtccggacatgaccgatctcgctccccggcagctggaggcgtcatctcgtgccctcgatctgggtcgcccgggctctggtctcgagctcggaattggcgcctgcacgcgcagctgactgtgatttggcaccgacctatctatcccgccactctgcaagcggattcgtggtggggggattctgtcttccccaacgcggccatgatcagggaatgtgatgggatggtccgtcggtatccgtgatcgatctgctggtttagttgctcgtgttctattcgtctcggtggttccggattgcctccaggagctacatatgggttaaggttgcttgcttgggattaggaggaacctagcttgtgattgtagcgcggaggacattctacagcattgcacgggtggtggcgtggtgcgtccagtgattaacggtagcaaccgactaacgatacgaccgaaatggttgggtggtgagaagctactgcatggaggagacacggagctgccgagctgggttgacctagcattggatatttgcttgcttgtcgaaacaatgctgtcgttcagcaagcttgctgtttatttgcatttggtacttgctgctaagtctggcctgtgcatcctcccaacccaaagattgaattccatgggtctgccatgctccttttctctctcaactgaatcgatgcagattttggtttaggtcctaaatttccttactagactagaatttaatattagtgttcatccggaatgaaaaaatgaggattgaagacacattatttggcgtgctcttgtggttgatgtgctctcaatcgagaagcttcagttcagagcatgtcagttcaccacattgtagtatagttggtgacatgtagtttgtggactctgtgttgtaatataagttaattgcctacctcttcctattagtttaagcttttgggttgaattggttgttgcatgcaacttaatatgatacatgaaccaaatgttacgagttcgaaccctggttagcacaattaaaattaaataattgttgcttgctcctattctacatctgagactaatagaggctcggcgtgagggagagtattgtaatataagtgaattgctgatagcgcaattaaaataaaatattcgttgctcgcttctattccgcgtctgagacctaatagaggctcgacgtgagggggagtgttgtaatataagtgaattgctcacctctttttatcagctttagcttttgggttgaactaattagtacatgcaacttaataatctgtagataactttgaccacactgctatatgatatgaccatatatctagtatttggcttcaattctacaagttatttgatcttctgcatttgtaacgcttccaacgtttctgttttaattgttgtttatataccaaattatttcctttcatttccttagtacaaaatggcgatgatggtggatcctccgaatggaatcgggaaccaaggaaagcattactactcaatgtggcagaccttatttgagatagacaccaaatatgtaccgatcaagcccattggtcgaggagcttatgggatagtttgttcatccattaatcgtgaaacaaatgagaaagtagcaataaagaagatacacaacgttttcgacaaccgtgtggatgcactacggaccttgcgggagctgaaactccttcgccatctccggcatgagaatgtcattgctttgaaggatataatgatgccaatacacaggagaagctttaaggatgtgtacttggtatacgaactcatggatactgatttgcaccagataatcaaatcacctcagggcctttccaatgaccactgccagtattttctttttcaggtaaaacttggatcactcttccctgttctgaatgtactctttcatatctgtgttgttcaacaaatacaacctaaattctgtgtattgtaatgctctttagctattacttacctaaacaagtgttgttgcgaggtgtgcactaccacactgtacctcaactgcagcagaggagtattattagcattggcactaatctgaagttgaattttattgcattgatagtccactctgcgtgtcagtttagtcatgatatcaaaatcaatctaagcccagcatctgtctcttctgaaaatcttctttcataagccatttttgcaaaacgttgttataataatattactagttcactaagaatattatgaaaatcatgaaatccagataggatgagaaaattaatatgaaataattgcatccagaagagcataatctccagtgatattctggttgattttacaaattcttgcacttagttgatcgaccagttatcttctcttttgaagctaaagatttctctgcaaatatggacaacttcggatttaatgttgtggaactatttacttttatagttcttttgagctcaaaagaagaatcttaccttttgggttatattaaaaaaactcgacctgcaggaggtaagacaaccctgggtattatattaaaaagaatgttagagtgaacacactgaccagttcaatccaaaagcttaagctgatgagacaaggtagtcaatccacttatacacttcaacacccccacttgcgtgcatccagagagaggcgcaaacgtggaaataaatggctggaggcacaaataaagcctttgctacgattcgaactcgagatctctggctttgataccatgttagagtagacgcacaacccaaaagtttaagctaatgggagaaggtagccaatcgcccccccccctccgcccgaacccctgccctacccatacagaacgacaccaaaacacgaccactaccaggaccatgccttagatctgtgctttgccgtgggacaaacgaggggatttttttaaccacagcctgaaattcgctcctacggggagtctaacccaggacttgaggactgctactcagactacctaaacaactcagctagaggcccttttgcttttgggttatattttagtccatataatagttcagatctggtacgcatcctctcttttttgtatgcaagttgaaatcagcaagcagttgagcatgctgcacatgtgaatatctgtcaccatgtttctgttttcctctttggcaagttttcaattttttcaagtttgattttatctgcttacgttatcacatgcaaacaattcacagtcattctcccattggcttatcaaatatgcatacgcaattatacattattgcccacatgctttgtgcagcttaacaccttccctttagatgtttacatattttagcttatgttactgacttgctcgagccagatctcccactccaaatgatatgtcaagtaagacagcttgcaccttatttgatcagacttcctgttccaaataaaacaacagcttttattgaaaaatgaatcatctggtaaagctagcagttctttcagccagcttgcatatttacaaagagttcatccaatagttttttattattattaccgagggggagagcctccttggctgaaaggtaggaaatgctgggaacgataggaatcgagaaaccaggaccggccagctcgtaccaccgagcctttaccactgagctacagctcagttcctagttcatccaatacttaataagtagttctgcatagggcttaagaatctattcagtgattaataagtagttatgcatgaagctgaaaaaatagagattatcctctacatgaagtaaggaccaggttgatttttttgtatttcgagaacccttgtatttttgccatttcatcttgatatttttatgtacgttatcgctaataatctgacgtacttatttttcttcattgtagttgctccgaggactcaaatatctccattcagcagaaatactccacagagacctaaaacctggaaacctgctggtgaatgcaaattgtgatctgaagatatgtgattttggtctcgcacgtacaaacagtagcaaaggccagttcatgactgaatacgtcgtcacccgctggtacagagctcctgagctgctcctctgctgcgacaactacggcacatccatagacgtctggtctgttgggtgcatctttgctgagctccttggccgcaagccaatatttccaggaactgaatgcctgaatcaactcaagctcatagtgaacgtcctcggcaccatgagtgaggctgacctagagttcatcgacaacccaaaggctcggagatacatcaagtcccttccctatacccctggtgttcccctcgtaagtatgtacccacatgcgcaccctcttgccattgatctgttgcagaagatgctcatcttcgaccccaccaaaaggatcagtgtcaccgaggctctcgagcacccttacatgtcccctctgtatgatccaagcgcaaatcccccagcccaagtgcccatcgatctggacatagacgaaaacatcagctcagagatgatccgggaaatgatgtggcaggagatgcttcactaccaccctgaagttgccacagcaataagcatgtcatgagagattccacagcccccaggacatcagcgggggctcacctcttctttttttgtctttgataaaagcctactgcgagtagccgattattgcggcacctagctgttatagtacacttaatgtctgcttggaaccaattatggcgcctagctgttgtagtacccttaatgtctgcttggacacttccgcttgtgtaaatacgcgcccaataagagcggcgtatggatagatgctgtcactatggaccattacttgttgtatgcactgtatatctgtggactgttgtggtgttgtattagttcatgaaccatgaagctttgaagtaaaaatcccatgcatgttaagtttgtatgcttccctacctcttcttttgttaactctgttttctccaggagacacatcgtacatttgtaaaaaaaaaaacaagaaaaaa

SEQ ID NO: 223 - DNA, 5464 bp, Zea Mays
ccgccgcgccccctcgcgtccgttcctcccttcctttccgtgtcggtctccggcgcgcccgacgtagcgcccgcatccgacggccgtgggggcatcgacggccgggcgacgcgacgcgatgtgaccatgacccgtcagtcagcaggtcagaatattcctcccctctcccggtcctccccacccccatccctcctcacggtcacggcacgggactcgcctccccccctcctcttcctcccctcccgcccacggctggaggtgctcacagcgagcggagcggaggcgagggattcggccgcgcgcatggcgacgcctctctgaccgaagctgctccacccactcggccaggcgcgccgtcctctcctctcccctccccttatcctctcgtgtgagtggaaatcttccgcgttttctccttcgttcgctttctgtctgtattgtctgctatggtttgcgctccgacgaccgaccgaccgtccgttcgtgtccggacatgaccgatctcgctccccggcagctggaggcgtcatctcgtgccctcgatctgggtcgcccgggctctggtctcgagctcggaattggcgcctgcacgcgcagctgactgtgatttggcaccgacctatctatcccgccactctgcaagcggattcgtggtggggggattctgtcttccccaacgcggccatgatcagggaatgtgatgggatggtccgtcggtatccgtgatcgatctgctggtttagttgctcgtgttctattcgtctcggtggttccggattgcctccaggagctacatatgggttaaggttgcttgcttgggattaggaggaacctagcttgtgattgtagcgcggaggacattctacagcattgcacgggtggtggcgtggtgcgtccagtgattaacggtagcaaccgactaacgatacgaccgaaatggttgggtggtgagaagctactgcatggaggagacacggagctgccgagctgggttgacctagcattggatatttgcttgcttgtcgaaacaatgctgtcgttcagcaagcttgctgtttatttgcatttggtacttgctgctaagtctggcctgtgcatcctcccaacccaaagattgaattccatgggtctgccatgctccttttctctctcaactgaatcgatgcagattttggtttaggtcctaaatttccttactagactagaatttaatattagtgttcatccggaatgaaaaaatgaggattgaagacacattatttggcgtgctcttgtggttgatgtgctctcaatcgagaagcttcagttcagagcatgtcagttcaccacattgtagtatagttggtgacatgtagtttgtggactctgtgttgtaatataagttaattgcctacctcttcctattagtttaagcttttgggttgaattggttgttgcatgcaacttaatatgatacatgaaccaaatgttacgagttcgaaccctggttagcacaattaaaattaaataattgttgcttgctcctattctacatctgagactaatagaggctcggcgtgagggagagtattgtaatataagtgaattgctgatagcgcaattaaaataaaatattcgttgctcgcttctattccgcgtctgagacctaatagaggctcgacgtgagggggagtgttgtaatataagtgaattgctcacctctttttatcagctttagcttttgggttgaactaattagtacatgcaacttaataatctgtagataactttgaccacactgctatatgatatgaccatatatctagtatttggcttcaattctacaagttatttgatcttctgcatttgtaacgcttccaacgtttctgttttaattgttgtttatataccaaattatttcctttcatttccttagtacaaaatggcgatgatggtggatcctccgaatggaatcgggaaccaaggaaagcattactactcaatgtggcagaccttatttgagatagacaccaaatatgtaccgatcaagcccattggtcgaggagcttatgggatagtttgttcatccattaatcgtgaaacaaatgagaaagtagcaataaagaagatacacaacgttttcgacaaccgtgtggatgcactacggaccttgcgggagctgaaactccttcgccatctccggcatgagaatgtcattgctttgaaggatataatgatgccaatacacaggagaagctttaaggatgtgtacttggtatacgaactcatggatactgatttgcaccagataatcaaatcacctcagggcctttccaatgaccactgccagtattttctttttcaggtaaaacttggatcactcttccctgttctgaatgtactctttcatatctgtgttgttcaacaaatacaacctaaattctgtgtattgtaatgctctttagctattacttacctaaacaagtgttgttgcgaggtgtgcactaccacactgtacctcaactgcagcagaggagtattattagcattggcactaatctgaagttgaattttattgcattgatagtccactctgcgtgtcagtttagtcatgatatcaaaatcaatctaagcccagcatctgtctcttctgaaaatcttctttcataagccatttttgcaaaacgttgttataataatattactagttcactaagaatattatgaaaatcatgaaatccagataggatgagaaaattaatatgaaataattgcatccagaagagcataatctccagtgatattctggttgattttacaaattcttgcacttagttgatcgaccagttatcttctcttttgaagctaaagatttctctgcaaatatggacaacttcggatttaatgttgtggaactatttacttttatagttcttttgagctcaaaagaagaatcttaccttttgggttatattaaaaaaactcgacctgcaggaggtaagacaaccctgggtattatattaaaaagaatgttagagtgaacacactgaccagttcaatccaaaagcttaagctgatgagacaaggtagtcaatccacttatacacttcaacacccccacttgcgtgcatccagagagaggcgcaaacgtggaaataaatggctggaggcacaaataaagcctttgctacgattcgaactcgagatctctggctttgataccatgttagagtagacgcacaacccaaaagtttaagctaatgggagaaggtagccaatcgcccccccccctccgcccgaacccctgccctacccatacagaacgacaccaaaacacgaccactaccaggaccatgccttagatctgtgctttgccgtgggacaaacgaggggatttttttaaccacagcctgaaattcgctcctacggggagtctaacccaggacttgaggactgctactcagactacctaaacaactcagctagaggcccttttgcttttgggttatattttagtccatataatagttcagatctggtacgcatcctctcttttttgtatgcaagttgaaatcagcaagcagttgagcatgctgcacatgtgaatatctgtcaccatgtttctgttttcctctttggcaagttttcaattttttcaagtttgattttatctgcttacgttatcacatgcaaacaattcacagtcattctcccattggcttatcaaatatgcatacgcaattatacattattgcccacatgctttgtgcagcttaacaccttccctttagatgtttacatattttagcttatgttactgacttgctcgagccagatctcccactccaaatgatatgtcaagtaagacagcttgcaccttatttgatcagacttcctgttccaaataaaacaacagcttttattgaaaaatgaatcatctggtaaagctagcagttctttcagccagcttgcatatttacaaagagttcatccaatagttttttattattattaccgagggggagagcctccttggctgaaaggtaggaaatgctgggaacgataggaatcgagaaaccaggaccggccagctcgtaccaccgagcctttaccactgagctacagctcagttcctagttcatccaatacttaataagtagttctgcatagggcttaagaatctattcagtgattaataagtagttatgcatgaagctgaaaaaatagagattatcctctacatgaagtaaggaccaggttgatttttttgtatttcgagaacccttgtatttttgccatttcatcttgatatttttatgtacgttatcgctaataatctgacgtacttatttttcttcattgtagttgctccgaggactcaaatatctccattcagcagaaatactccacagagacctaaaacctggaaacctgctggtgaatgcaaattgtgatctgaagatatgtgattttggtctcgcacgtacaaacagtagcaaaggccagttcatgactgaatacgtcgtcacccgctggtacagagctcctgagctgctcctctgctgcgacaactacggcacatccatagacgtctggtctgttgggtgcatctttgctgagctccttggccgcaagccaatatttccaggaactgaatgcctgaatcaactcaagctcatagtgaacgtcctcggcaccatgagtgaggctgacctagagttcatcgacaacccaaaggctcggagatacatcaagtcccttccctatacccctggtgttcccctcgtaagtatgtacccacatgcgcaccctcttgccattgatctgttgcagaagatgctcatcttcgaccccaccaaaaggatcagtgtcaccgaggctctcgagcacccttacatgtcccctctgtatgatccaagcgcaaatcccccagcccaagtgcccatcgatctggacatagacgaaaacatcagctcagagatgatccgggaaatgatgtggcaggagatgcttcactaccaccctgaagttgccacagcaataagcatgtcatgagagattccacagcccccaggacatcagcgggggctcacctcttctttttttgtctttgataaaagcctactgcgagtagccgattattgcggcacctagctgttatagtacacttaatgtctgcttggaaccaattatggcgcctagctgttgtagtacccttaatgtctgcttggacacttccgcttgtgtaaatacgcgcccaataagagcggcgtatggatagatgctgtcactatggaccattacttgttgtatgcactgtatatctgtggactgttgtggtgttgtattagttcatgaaccatgaagctttgaagtaaaaatcccatgcatgttaagtttgtatgcttccctacctcttcttttgttaactctgttttctccaggagacacatcgtacatttgtaaaaaaaaaaacaagaaaaaa

SEQ ID NO: 224 - DNA, 5469 bp, Zea Mays
ctgccccgccgcgccccctcgcgtccgttcctcccttcctttccgtgtcggtctccggcgcgcccgacgtagcgcccgcatccgacggccgtgggggcatcgacggccgggcgacgcgacgcgatgtgaccatgacccgtcagtcagcaggtcagaatattcctcccctctcccggtcctccccacccccatccctcctcacggtcacggcacgggactcgcctccccccctcctcttcctcccctcccgcccacggctggaggtgctcacagcgagcggagcggaggcgagggattcggccgcgcgcatggcgacgcctctctgaccgaagctgctccacccactcggccaggcgcgccgtcctctcctctcccctccccttatcctctcgtgtgagtggaaatcttccgcgttttctccttcgttcgctttctgtctgtattgtctgctatggtttgcgctccgacgaccgaccgaccgtccgttcgtgtccggacatgaccgatctcgctccccggcagctggaggcgtcatctcgtgccctcgatctgggtcgcccgggctctggtctcgagctcggaattggcgcctgcacgcgcagctgactgtgatttggcaccgacctatctatcccgccactctgcaagcggattcgtggtggggggattctgtcttccccaacgcggccatgatcagggaatgtgatgggatggtccgtcggtatccgtgatcgatctgctggtttagttgctcgtgttctattcgtctcggtggttccggattgcctccaggagctacatatgggttaaggttgcttgcttgggattaggaggaacctagcttgtgattgtagcgcggaggacattctacagcattgcacgggtggtggcgtggtgcgtccagtgattaacggtagcaaccgactaacgatacgaccgaaatggttgggtggtgagaagctactgcatggaggagacacggagctgccgagctgggttgacctagcattggatatttgcttgcttgtcgaaacaatgctgtcgttcagcaagcttgctgtttatttgcatttggtacttgctgctaagtctggcctgtgcatcctcccaacccaaagattgaattccatgggtctgccatgctccttttctctctcaactgaatcgatgcagattttggtttaggtcctaaatttccttactagactagaatttaatattagtgttcatccggaatgaaaaaatgaggattgaagacacattatttggcgtgctcttgtggttgatgtgctctcaatcgagaagcttcagttcagagcatgtcagttcaccacattgtagtatagttggtgacatgtagtttgtggactctgtgttgtaatataagttaattgcctacctcttcctattagtttaagcttttgggttgaattggttgttgcatgcaacttaatatgatacatgaaccaaatgttacgagttcgaaccctggttagcacaattaaaattaaataattgttgcttgctcctattctacatctgagactaatagaggctcggcgtgagggagagtattgtaatataagtgaattgctgatagcgcaattaaaataaaatattcgttgctcgcttctattccgcgtctgagacctaatagaggctcgacgtgagggggagtgttgtaatataagtgaattgctcacctctttttatcagctttagcttttgggttgaactaattagtacatgcaacttaataatctgtagataactttgaccacactgctatatgatatgaccatatatctagtatttggcttcaattctacaagttatttgatcttctgcatttgtaacgcttccaacgtttctgttttaattgttgtttatataccaaattatttcctttcatttccttagtacaaaatggcgatgatggtggatcctccgaatggaatcgggaaccaaggaaagcattactactcaatgtggcagaccttatttgagatagacaccaaatatgtaccgatcaagcccattggtcgaggagcttatgggatagtttgttcatccattaatcgtgaaacaaatgagaaagtagcaataaagaagatacacaacgttttcgacaaccgtgtggatgcactacggaccttgcgggagctgaaactccttcgccatctccggcatgagaatgtcattgctttgaaggatataatgatgccaatacacaggagaagctttaaggatgtgtacttggtatacgaactcatggatactgatttgcaccagataatcaaatcacctcagggcctttccaatgaccactgccagtattttctttttcaggtaaaacttggatcactcttccctgttctgaatgtactctttcatatctgtgttgttcaacaaatacaacctaaattctgtgtattgtaatgctctttagctattacttacctaaacaagtgttgttgcgaggtgtgcactaccacactgtacctcaactgcagcagaggagtattattagcattggcactaatctgaagttgaattttattgcattgatagtccactctgcgtgtcagtttagtcatgatatcaaaatcaatctaagcccagcatctgtctcttctgaaaatcttctttcataagccatttttgcaaaacgttgttataataatattactagttcactaagaatattatgaaaatcatgaaatccagataggatgagaaaattaatatgaaataattgcatccagaagagcataatctccagtgatattctggttgattttacaaattcttgcacttagttgatcgaccagttatcttctcttttgaagctaaagatttctctgcaaatatggacaacttcggatttaatgttgtggaactatttacttttatagttcttttgagctcaaaagaagaatcttaccttttgggttatattaaaaaaactcgacctgcaggaggtaagacaaccctgggtattatattaaaaagaatgttagagtgaacacactgaccagttcaatccaaaagcttaagctgatgagacaaggtagtcaatccacttatacacttcaacacccccacttgcgtgcatccagagagaggcgcaaacgtggaaataaatggctggaggcacaaataaagcctttgctacgattcgaactcgagatctctggctttgataccatgttagagtagacgcacaacccaaaagtttaagctaatgggagaaggtagccaatcgcccccccccctccgcccgaacccctgccctacccatacagaacgacaccaaaacacgaccactaccaggaccatgccttagatctgtgctttgccgtgggacaaacgaggggatttttttaaccacagcctgaaattcgctcctacggggagtctaacccaggacttgaggactgctactcagactacctaaacaactcagctagaggcccttttgcttttgggttatattttagtccatataatagttcagatctggtacgcatcctctcttttttgtatgcaagttgaaatcagcaagcagttgagcatgctgcacatgtgaatatctgtcaccatgtttctgttttcctctttggcaagttttcaattttttcaagtttgattttatctgcttacgttatcacatgcaaacaattcacagtcattctcccattggcttatcaaatatgcatacgcaattatacattattgcccacatgctttgtgcagcttaacaccttccctttagatgtttacatattttagcttatgttactgacttgctcgagccagatctcccactccaaatgatatgtcaagtaagacagcttgcaccttatttgatcagacttcctgttccaaataaaacaacagcttttattgaaaaatgaatcatctggtaaagctagcagttctttcagccagcttgcatatttacaaagagttcatccaatagttttttattattattaccgagggggagagcctccttggctgaaaggtaggaaatgctgggaacgataggaatcgagaaaccaggaccggccagctcgtaccaccgagcctttaccactgagctacagctcagttcctagttcatccaatacttaataagtagttctgcatagggcttaagaatctattcagtgattaataagtagttatgcatgaagctgaaaaaatagagattatcctctacatgaagtaaggaccaggttgatttttttgtatttcgagaacccttgtatttttgccatttcatcttgatatttttatgtacgttatcgctaataatctgacgtacttatttttcttcattgtagttgctccgaggactcaaatatctccattcagcagaaatactccacagagacctaaaacctggaaacctgctggtgaatgcaaattgtgatctgaagatatgtgattttggtctcgcacgtacaaacagtagcaaaggccagttcatgactgaatacgtcgtcacccgctggtacagagctcctgagctgctcctctgctgcgacaactacggcacatccatagacgtctggtctgttgggtgcatctttgctgagctccttggccgcaagccaatatttccaggaactgaatgcctgaatcaactcaagctcatagtgaacgtcctcggcaccatgagtgaggctgacctagagttcatcgacaacccaaaggctcggagatacatcaagtcccttccctatacccctggtgttcccctcgtaagtatgtacccacatgcgcaccctcttgccattgatctgttgcagaagatgctcatcttcgaccccaccaaaaggatcagtgtcaccgaggctctcgagcacccttacatgtcccctctgtatgatccaagcgcaaatcccccagcccaagtgcccatcgatctggacatagacgaaaacatcagctcagagatgatccgggaaatgatgtggcaggagatgcttcactaccaccctgaagttgccacagcaataagcatgtcatgagagattccacagcccccaggacatcagcgggggctcacctcttctttttttgtctttgataaaagcctactgcgagtagccgattattgcggcacctagctgttatagtacacttaatgtctgcttggaaccaattatggcgcctagctgttgtagtacccttaatgtctgcttggacacttccgcttgtgtaaatacgcgcccaataagagcggcgtatggatagatgctgtcactatggaccattacttgttgtatgcactgtatatctgtggactgttgtggtgttgtattagttcatgaaccatgaagctttgaagtaaaaatcccatgcatgttaagtttgtatgcttccctacctcttcttttgttaactctgttttctccaggagacacatcgtacatttgtaaaaaaaaaaacaagaaaaaa

SEQ ID NO: 225 - DNA, 1131 bp, Zea Mays; identical to SEQ ID NO: 50

SEQ ID NO: 226 - DNA, 1313 bp, Zea Mays; identical to SEQ ID NO: 51

SEQ ID NO: 227 - DNA, 2687 bp, Zea Mays; identical to SEQ ID NO: 52

SEQ ID NO: 228 - DNA, 1800 bp, Zea Mays
ctgcgcgacccttctcaggacgcgcaggcattgggacctgctcttgatttgtggaggcggcatttggagtttgtggtgcgccgtctcctcgactcggagcggcagctctgtgccaaggtgtttgggcagcataaggatgtcgcgtccgcgtgctttgcagaggtggcggcacaagccggggttcttgacttcttgaggtttggccgcgcggttgctgatgccaagaaggaccccatcaagctccagcgtctgctggaggtgtttgattctctgaataagctgagactggacttcaacaggttgttcggtggcaaagcgtgcgcggagattcagagccagacaagggaccttgtcaagttgttgatagacggcgccgtcgagatctttgaggagttgattgtgcaggtggagctgcagcggcacatgcctcccccagttgatggaggcgtgccgcgcttagttacctttgtcgttgagtactgcaaccgactgcttggtgagcaatacaggcctgtgcttgggcaggcgctaactatccatcgcagctggcgcaaggaggcgttcaatgacaggatgcttgttgacgcggtgctaaacatcgtcaaggcccttgaagctaacttcgatgtttggtccaaggcatatgacaacgctacgctgtcgtatctcttcatgatgaatacccattggcatttcttcaggcatctgaaggctactaagctaggagaggtcttgggtgatgtgtggctgcgagagcatgaacaatacaaggaatactatttgtcaatgttcatcagggagagctggggagcactttcagcgctactgaaccgggagggattaatattgttctccaagggccgggccactgcaagggacctggtgaagcagcgcctcaaaacattcaattcgagctttgatgagatgcatcgcaggcaatcgtcgtgggttataccagacaaggatctgcgggagaggacatgtaatcttgtggtgcagactatcgtccctacctaccggagctacatgcagaactatgggccacttgtggagcaagagggaaatgccagcaagtatgtaaggtacactgtcgatggtttggagaagatgctcagtgccctctacatgccccggcccaggagggctgggagcttccagatcaagcactcgagcggtaagattgccagtgcaatgactggcttgcatcggagtgcttctgcagtgaaatagcctatgttaaagaacccaaagattggatcaatatgatagtatgtggcaattggcaaatgattcatttggcccagtcaagcaaagagtcccgcactggataggtgaccgaataatggacccatggtcggagcagtggtgtcaagtgtcatatgaacataagttactctttagttagcatggagaatagaggctggtgatcagttccgtagctcctgttagtgtccctgaacataagttacccatggtctgagatgttaccattctcctgagctattttctcttgttgtgtacttctgctggtgtccctggcaccataatcattcatctggagatattcaatcagctgtgtagttatgtaaaatcgatttgtaattttagttttaggtgacctgtgggcattaccttttaatgtaccaagaatcgagcttaatagatgcaatggattatatggggggggggaaaaaactagacccctcgagcgagtgaggatgtgctatttgtttggtaaactagagcagatatgtacccccaatacaattgcattacatttactgaaagtacaacttgatc

SEQ ID NO: 229 - DNA, 766 bp, Zea Mays
atgccgggggagtggtccgtggggctctgcgactgcttcggggatcttcacacctgtacgcagtgcaaacaaacctgctagctatagcaagctactctcctctctctctcttcttcttcttcccgtacgtactacgatgcatgtttttcagctctccgtcccttctctcccggccgacgatcgaccacgttgcaggttgcctgacgctctggtgcccctgcgtcacgttcggccgcaccgcggagatcgtggacagaggctccacgtgtacgcgttccacttcactcccatactactactgcccccctcgtctcgtctccatctctcctgttccttttggctgacgatccgtcccgcattgcatatttgcagcgtgctgcatgagtggcacactgtactacctgctgtcgacgataggctggcagtggctgtacggctgcgccaagcgctcctccatgcggtcgcagtacagcctgcgagagtccccctgcatggactgctgcgtccacttctggtgcggcccctgcgcgctctgccaggagtacacggagctccagaaacgcggcttccacatggccaaaggtatcagctcccccccccatcttcccacagtttaactaggcggcctttgatggttccatgatcaccgtgcctctacaaaaccattatattccttttatttgcaggatgggaagggagcaacaaggtggtggggtgcttccatgggatgacgacgccaccaaggaagcaatccatgtgcttttag

SEQ ID NO: 230 - DNA, 4847 bp, Zea Mays
acggttatttcgtatcagcaatagcatacgccccacgtccccacgcggccacgccttctttcctctctgcccccaccacgaaactccacgacgacgcgtccgcgcaccaggcaggcacgaccaccaccgtggcaccgtccaccggagccgagcaacgcgaggagttgagccgatggaggtggcgtcgggggatgaggatctggaatcgctgctccagaacttccatcgcgtgtcccaggtactcgataccagccgcacggcaccccctactgcccagttgccagttctacttacactacggccgcccggccgcgaatcgcgttccggcgcactcagtccacccgcgactcgtttcggtttggtttcgaatgatcgcgctccgcgctgcactggcctgctagggtcatcggcggttcgtttcacgtgttgattcagtgaccagttcgagaaatggaagttgtagtgatcgttcgttgaaccattcagtctgtactcaggcggcgcgtgctccctgctcagcctgtattcgatgaaattacaaagtggttgcagttggagagtgggtgcctccagctacattggcatgttttacaaaatttgcgtccagagagtgtagcgtggtgttgttggtagcagaataagctgcctgctaactgatgttgtatctggacaatgttgtggttgccttgctggtagatatacataagctcaattgcttctaaatgtccagttgttctagtttaccttgcctaaggaacatggcctgtgttgtatgtttcatagtacccgttagcattttctgtccttattggtcttgtgttgtctttattttctttcttttttcctgaacaggggtacaaagatgcacttatgcaggtccaggttttaagagtaaattgcagcactgagttcaaaaggcgggaagctcttgaatcacatattacagatcttaagaaaggttagccgcttcagccgtctctacaagtttaaactcaatctcctgtcttaagagtctgtaaattttgcggtagcttatcatttacctttccttctgagatcgaaagaaacgagtaactgttcatgctctgcagataatgagcggttaagaaggcaatacacagaaactttattcaaggtcaccaaccaggttggttgctacttactatgtgcatttatataagtgtaattgcataaatcaaggctagcaagtgccattttcacctatgatctaactgagaagtgagaacagggttcttcattccatgggagcagttttaacagatgtgatgactagttgactgccaaatgcttctgtagtttggtcttgattttttttaatcttttcctggaaatgcggcggaaccagtacaacaacatgtattataataggacatcagtatgtctctgttatggtcactagatcggtgagggattggagaggggtatcgatgggcaggaacgtcggccgggggcctttgcccacggccaagcaagaggagggtttgtcccttctaattcttgcctactttatttctcatccattgattacataaataggccagttggccgcccctatctagctagagatccttatctccttaaaactctcctaaaaactctcaacaaactaactgataaccttcctagataatctcaactaatctcctaaataatctcaactaatcttctaatcttatctaatcccccttggagggccatggctgctgctactgcatctcctccatgggcctccttaggccctgacactacaccctcctggacaagcagctcgtcctcgagctgcagcatgacgggtgctcaaagaccgagtctacttgacccaaaaccagacacctagaagacaagtcttttacatctcggcttatcttattattccgaatctgaattttttttgacccgtaagataagacggacaccctccgcgcattggacttgcacgtgtgcagccacctggatcccatggacgccatctagacgaaaggggagcacatggacgggcacctggaataggtcgcaacaataaccagcggaggcgccctcgtggcggccggtagcggaatgtggtggcgctaaatagtgcgcccttgccgatgacgaggggagtgccttccttaccgctgctgccgtataattgaagttcgtcgcccgcaggaaacgcaccatgcccgcacttggaaatagcggcccggagccgctgctgatggccgtccgacaaggcgaggtcgtgcccccatgtgccgaggtctaccgtcaccaaggctgcctcgagcatctgtcggcgcatctcccgcactctctgtcgtgcaaggaagccacgagcagcagcttgtatgcccacagccgccaacgtctggagccgtgcagacaacgccagctggtgctgctcatgttgcactgctaccttgatttgcagcagcccttgctcaaccttctggagcgtggcttgcatctttgcgagatcagcccttatgttggtccacaagtctcccatcgatggagctgatgattgctgagccgtggctgcccctagtggcgtcgccccatggggacggagacgccgtcaacgaagatgatgtgatgaaatttggcgttatccctggggatgggcacgccggcgtccaggatgtggtgacaaaattggcaggcgatgctgcccatggagatagggacgctggttgccaggatggcgtgacgaaggtggcatgcggcgcagcccatggagatggggacgtcggttgccaggacggcgtgacgaaggtgacatgtggcgctgtccatggagatggggacgccggttgccaggatgtcgccgcgaaattggcagcagaagccatgggatcagatcgaaacccaagctagccgataccagatgttatggtcactagatcggtgagggattggagaggggtatcgatgggcaggaacgtcggccgggggcctttgcccacggccaagcaagaggagggtttgtcacttctaattcttgcctactttatttctcatccattgattacataaataggccagttggccgtccctatctagctagagatccttatctccttaaaactctcctaaaaactctcaacaaactaactgataaccttcctagataatctcaactaatctcctaaataatctcaactaatcttctaatcttatctaatcccttggagggccatggctgctgctaccgcagctcctccatgggcctccttaggccctgacagtctcaacatctgtttatggacaataggacattgtgatgtctaggaatgtgggttgtcgtcaagtattattatatgatatgtgctttgtttagtatgctgtgcctatgattgataataaaactaaggattatttctaacctgacatgctattcaggtgaaattccgcgcagaagctcaaagcctgaaggaagagctggacaaggcaaatagtagattgttatccatggaagaggtaactaattgctctctaacacagctaagcttctgggtaatctacaaattaatctatacatgcatcaatttaattcaggaacacaagagggaaactgagcaacttaagcacagcagtgaaatgaacatcaatgccctggagaacaagctcaggtaagaaacatcgattgagggaggctgcataagattgctgagggagtcatattcagacaaattttccttctggttgctttgtgaatactgaaccagctaccgactttcactgcaatcagccacgcccttgtacagcaagcaagagatgaagctgcaatgaagcaactgaagttggagctgagtgcccataaatctcacatcgacatgttaggtagcaggttggagcaggttactaatgacgtgcattcgcagtgtaatgttcttaatttcccttctacgtttaagattagcccttcttctgaaatagagtctcttatcccatctgatggcaattcttcctggtcccttgtacagataaaaatgagatccaggatttgagggatgtggtttctgttgaacaagaggagaaaaaggacattcacaggaagcttcagaatgtggaaaacgagtgtatgttcgagctgaattggtgaactgaaaaaaaaaagaagatgagtttctgcaaacagcagacgtcatgaaccaattcaaacaggaaaacaaaaacatgattcgtatccccaacatgcttattaagtagcgttccatgggcttgcctttcagttctgaaaagggaacacaaaatatgaaccaccaaccccttgtctgatcttcagaaagtagcaaaattttccttatcagtgcattgcttcttggtggccttaacatgttctctaatgatgcagtgaggatcacgaggatgaagcaggcggagcagcaaagggattctgtctcggtccagcacgtggagacgctgaagcagaaggtcatgaggctccggaaggagaacgagtccctgaagaggaggctggcgagctctgaagtctgaactggagtgcacatgaaaactgcaactgctttccttcacgccgtagttttatctcatactgtaggatgtagaaaaatccactgctccaaaaacacatatcacttccagatgctttaaaactagcaatgataggtatgttttcactgaaagttattatcaccaatcgacacactcataaccttttcatatgaaattatataaagataaactctatgtccaagatatagagttcaaagaactttttagttgacaacattttcatataagacaatttggatgttcgaatattcaatataaagatcacatgcctattaaactatcttgggtaaaaaatataatcaaca

SEQ ID NO: 231 - DNA, 4210 bp, Zea Mays
acggttatttcgtatcagcaatagcatacgccccacgtccccacgcggccacgccttctttcctctctgcccccaccacgaaactccacgacgacgcgtccgcgcaccaggcaggcacgaccaccaccgtggcaccgtccaccggagccgagcaacgcgaggagttgagccgatggaggtggcgtcgggggatgaggatctggaatcgctgctccagaacttccatcgcgtgtcccaggtactcgataccagccgcacggcaccccctactgcccagttgccagttctacttacactacggccgcccggccgcgaatcgcgttccggcgcactcagtccacccgcgactcgtttcggtttggtttcgaatgatcgcgctccgcgctgcactggcctgctagggtcatcggcggttcgtttcacgtgttgattcagtgaccagttcgagaaatggaagttgtagtgatcgttcgttgaaccattcagtctgtactcaggcggcgcgtgctccctgctcagcctgtattcgatgaaattacaaagtggttgcagttggagagtgggtgcctccagctacattggcatgttttacaaaatttgcgtccagagagtgtagcgtggtgttgttggtagcagaataagctgcctgctaactgatgttgtatctggacaatgttgtggttgccttgctggtagatatacataagctcaattgcttctaaatgtccagttgttctagtttaccttgcctaaggaacatggcctgtgttgtatgtttcatagtacccgttagcattttctgtccttattggtcttgtgttgtctttattttctttcttttttcctgaacaggggtacaaagatgcacttatgcaggtccaggttttaagagtaaattgcagcactgagttcaaaaggcgggaagctcttgaatcacatattacagatcttaagaaaggttagccgcttcagccgtctctacaagtttaaactcaatctcctgtcttaagagtctgtaaattttgcggtagcttatcatttacctttccttctgagatcgaaagaaacgagtaactgttcatgctctgcagataatgagcggttaagaaggcaatacacagaaactttattcaaggtcaccaaccaggttggttgctacttactatgtgcatttatataagtgtaattgcataaatcaaggctagcaagtgccattttcacctatgatctaactgagaagtgagaacagggttcttcattccatgggagcagttttaacagatgtgatgactagttgactgccaaatgcttctgtagtttggtcttgattttttttaatcttttcctggaaatgcggcggaaccagtacaacaacatgtattataataggacatcagtatgtctctgttatggtcactagatcggtgagggattggagaggggtatcgatgggcaggaacgtcggccgggggcctttgcccacggccaagcaagaggagggtttgtcccttctaattcttgcctactttatttctcatccattgattacataaataggccagttggccgcccctatctagctagagatccttatctccttaaaactctcctaaaaactctcaacaaactaactgataaccttcctagataatctcaactaatctcctaaataatctcaactaatcttctaatcttatctaatcccccttggagggccatggctgctgctactgcatctcctccatgggcctccttaggccctgacactacaccctcctggacaagcagctcgtcctcgagctgcagcatgacgggtgctcaaagaccgagtctacttgacccaaaaccagacacctagaagacaagtcttttacatctcggcttatcttattattccgaatctgaattttttttgacccgtaagataagacggacaccctccgcgcattggacttgcacgtgtgcagccacctggatcccatggacgccatctagacgaaaggggagcacatggacgggcacctggaataggtcgcaacaataaccagcggaggcgccctcgtggcggccggtagcggaatgtggtggcgctaaatagtgcgcccttgccgatgacgaggggagtgccttccttaccgctgctgccgtataattgaagttcgtcgcccgcaggaaacgcaccatgcccgcacttggaaatagcggcccggagccgctgctgatggccgtccgacaaggcgaggtcgtgcccccatgtgccgaggtctaccgtcaccaaggctgcctcgagcatctgtcggcgcatctcccgcactctctgtcgtgcaaggaagccacgagcagcagcttgtatgcccacagccgccaacgtctggagccgtgcagacaacgccagctggtgctgctcatgttgcactgctaccttgatttgcagcagcccttgctcaaccttctggagcgtggcttgcatctttgcgagatcagcccttatgttggtccacaagtctcccatcgatggagctgatgattgctgagccgtggctgcccctagtggcgtcgccccatggggacggagacgccgtcaacgaagatgatgtgatgaaatttggcgttatccctggggatgggcacgccggcgtccaggatgtggtgacaaaattggcaggcgatgctgcccatggagatagggacgctggttgccaggatggcgtgacgaaggtggcatgcggcgcagcccatggagatggggacgtcggttgccaggacggcgtgacgaaggtgacatgtggcgctgtccatggagatggggacgccggttgccaggatgtcgccgcgaaattggcagcagaagccatgggatcagatcgaaacccaagctagccgataccagatgttatggtcactagatcggtgagggattggagaggggtatcgatgggcaggaacgtcggccgggggcctttgcccacggccaagcaagaggagggtttgtcacttctaattcttgcctactttatttctcatccattgattacataaataggccagttggccgtccctatctagctagagatccttatctccttaaaactctcctaaaaactctcaacaaactaactgataaccttcctagataatctcaactaatctcctaaataatctcaactaatcttctaatcttatctaatcccttggagggccatggctgctgctaccgcagctcctccatgggcctccttaggccctgacagtctcaacatctgtttatggacaataggacattgtgatgtctaggaatgtgggttgtcgtcaagtattattatatgatatgtgctttgtttagtatgctgtgcctatgattgataataaaactaaggattatttctaacctgacatgctattcaggtgaaattccgcgcagaagctcaaagcctgaaggaagagctggacaaggcaaatagtagattgttatccatggaagaggtaactaattgctctctaacacagctaagcttctgggtaatctacaaattaatctatacatgcatcaatttaattcaggaacacaagagggaaactgagcaacttaagcacagcagtgaaatgaacatcaatgccctggagaacaagctcaggtaagaaacatcgattgagggaggctgcataagattgctgagggagtcatattcagacaaattttccttctggttgctttgtgaatactgaaccagctaccgactttcactgcaatcagccacgcccttgtacagcaagcaagagatgaagctgcaatgaagcaactgaagttggagctgagtgcccataaatctcacatcgacatgttaggtagcaggttggagcaggttactaatgacgtgcattcgcagtgtaatgttcttaatttcccttctacgtttaagattagcccttcttctgaaatagagtctcttatcccatctgatggcaattcttcctggtcccttgtacagataaaaatgagatccaggatttgagggatgtggtttctgttgaacaagaggagaaaaaggacattcacaggaagcttcagaatgtggaaaacgagtgtatgttcgagctgaattggtgaactgaaaaaaaaaagaagatgagtttctgcaaacagcagacgtcatgaaccaattcaaacaggaaaacaaaaacatgattcgtatccccaacatgcttatta

SEQ ID NO: 232 - DNA, 5434 bp, Zea Mays
gtttattttcacttagaaaaatagaaatcacttggtgaaataaggttccaaactagaacttaaaaaaatagagttctaaaactagccctgaccctgattattgaatgaccattgtaccggtaaccatttataatcgtacacccaaaagaatcagacagatacccgttcacccctcgctctcgctgccacttctcccgttcggcctctttttccttccaccaatggaagctctcacagcccgctcctccgtactctcgccgccggggattgccggagacacctcgccctcccttcccctgcccctccgccgagcctccgccgcgtttcttgggcctcgcaggagcccctccgccctcgccatctccacgcgctggctgcgcgctccgcctcgacgcggcggccgcctgctcgcgggggaaggggaagaagtgccccccgaccccgccgatgacgcggctggccgggcggaagattttctagtactcgaggtactcgctgatgatatgatatgttgttattggagatccaacccgtgcaattctgtacctgacgtattgtgctgtacttcagtagtacggagttttgcgacagttcaactgctatgataataaggagcttccatcagtagaacaattggaactattgttttgacatagatacgttatatttccatttgaagatttaaattgcctgtctaacttggcagaacctcagattgtttaatcaacgggaaaatacaataatctgcgaggaattcgctcgtcaagtagtatgtagtatcaattgctgaaggatgactaatttggcaaaatagctttattataataatgaccttttagtatatgatatgtaaccgagttcactaaggacctgtttgtttggttggagttgaattccattctaataatcataatttagacacaaactaattaagttaatacatttgtatatgcaatttatttgtatattatcctaaatcatatgatagagatagttatacactacacttatgctataaaaaaccaagtagaagagtgtgctataagttgtactttagaaaagtagcatgtaaatctatagaatcaatttccatctctcatcccatgaatttgtgataagcttttatataaactttgggaagttatggtttatggaatgccacattctaaaaaatagcctactccattagttagattccaattcctcaaaatcaagggaaacaaacgggtcctaattgatttggtagcttttgccaaagacaaattatagctactaccgcattgttctaaagggaacctgacctctgcataatattgcacggtgttcagttagattgtatttattaaaatttaagctagttcgtcaatgaagtcactttggatgggagttctgcgctacatttttgtgcaggcatctgttactttaattgttcatatttggcctttatctttgccaaaaatattcctggtgggctgattatggatggtggattgacctttctctagatgtctttataagtattgaaagtgatatgctaatgccttaggaggacattttgctttctttgtaagtttgtgtcttcttacttttcgtaattatatttcctttgtaagttcgtcgttttttttcattctccatcttgaacagttgaagtgctttagctttatgagaaacctcaccactaagtcaaagtgatattatgactgtaagcacatgctctttttctttgttatttgtgtgttgatgcctgcagggcaggcctagtgcggtggtgagagctgtctcactgagcagtattcccgcatttgcgggggaaggcttgcctcggtttatccctttgctagaccccactccctttgtgtgttgatgcctgaaaagtcaaaatatcacagtaattaaaattacaagcaactacaattaagtgtacgctggggcaatgaactatggcaatgctcacccactcactcgtaaatctccatgtttttttattggggaaatattttctttcataagctcttaccctttgggcgccgtgacacattcagctaattgttattgctctgtataatttattttttatgagctctccaagattgactattgttctcttcctgtttgtaatattgaaagaataatgtaactctacgccaaagcaatgacatggataccattaaacatgatgatgctggcacttctggaattggtgggagtaacactggtggctctaggactggcctattcagaacacctatttcaggtggtgtgcacagtgcaactgctgttcatgatttaccaccaccagctttggctgttcgcaacctcatggaacaggtgtatttacgctctcctgtgtttggtttagttgtatctgagttagaaagaggtgaacatttaatatggatatgagaaagaacatgtaatgacaatgttcatatttttttaaaccaggcaaggtttgctcatctgtgcactgtaatgtctcggatgcatcaccgccgtgagggatacccattcggttccctagtagattttgcacctgacccatttggccgtaagtaattttaatatcacatcttgtacctaccaagtttctagattgattttttatttatttattgcatttttgtcatgaagacccgatcttctcattatccccactagctatccacacaagaaatttgttggcagacccaagatgcacccttgttgtacaggtaaattttgacaatcgactatactatataatcagctcttgagtgtctttgttgatttcgtactaaaattctgaaccttaggttcctggatggagtgggctatcaaatgcacgagtaactatctttggcgatgtcattccgttgcccactgaacaacaggtttgcactaaaatcactactgatgttatctcttttcctgaataccatctctcacaatgccatgtcacttaattcagtaaattttgtgtttgatatttacactatgaagctatttctggacatgtgtgctatattgccattatttcgttcatatctgaactatgtactgcagaaagctaacccctgctggcttcagcaggctatatgatggtcatacatggaatgaacaaaataaactcaaaatcaagccacctatttgaacttgccttcagcttaagacatgccaaagttgaagtcacagttttttttcctacttatggttactaatccttatagctaccaatcaataggagtcaccctaactgaaaacctgccaaaaatgggggtaaaagactcatgaacatgagttaagcatctgggagttggagttttgtttcctatgaggtaggtaaccaggtatatgatgtaaagaacttggccagaagctctataagaatactgaggaggcaactattttcatgtgcttctgccttggatattcttctgttcagatatttgttcaaatcttgaatagaattaatacatctgtatcaggaatgggctcatcagcagtatgtttcaaagcaccagcagtgggcatcccaacagtggggtaacttttactattacagaatgcacacaataaggtagttcctgaatttgcatgaatgagaactattttctccacttttggtattagtgttcttcgagatttcatgggcattggtcaattggtgtttctgtataagatgcattttcttcttggcttcttgcttgtctggttgtgataaaagcaaaacaaagtacacaagatttgtagctaattagtttactatttgagttcactttcaaggcgaagcagttataattgttagaatataatataagtgaattgtccaaacttttgggttgaattggttggtacatgcaacttaatatggtatcagagctagaggtcatgagtttgaattttggttagcacaattaaattaaataattgttgcgcgctcctatatttcacgtgagggggtgttagaatataatataagtgaatcgtccacctccttctcatcagtttaagctttttggttgaattggttggtgcatgcaacttaataataattgaccagtatgcatgatcaatatgtacttttgtttctaactcattgaatttagtaaaaaaacaaaagcaagagcactcttacaacaaccaagggaactagtcctttgtaatactataaaattcgtggttcagttgtcctaattgtcttttattcagatgatcagatctctttctctagcccttttcctgccaatgtggagtttcaatattgtgaggtcatataagtttaacttttttagtttgatataatcacataggttttgtagtatcagtagtacaccctcgcataattaattgtctctgtgttgcctccgtttttttagatccattgataactctggtaattacatgcgaactttgttgcagtgacatatatttcattggaggttttggtactgttgcttgggtagatgtgaacgaatatgaggctctgcaacctgacaagattgctatggatggaggggaacaaaatctgaaggtaagctaatgagtatttgctcagagaacagcctgaagaagtgaagatctcaatgtattccatgaactcttgtagctcatttgatcttagacactatgcatacttggaagtgattcctctgctctgtctgttgccctttgaacaggaactcaacgcaatgttctcaaagcctctgaaagagcttttgtcaactgatgaaggagaggtagacgatgttgctcttatttcaatggacagcaaaggtatcgatatccgtgtccgacaaggtgcacaggtacagccttcagaagatctttagcacgtagatatgcaaatccaacaccctcaagtttttgctttccacttttcataattgagatcacacgcctatgtgttatgctgccattgtacggtggtggttatttcgcagaacagcatagtgttaaagcccttttctgttcttgggcatgttttgcagttcaacatacagagggtgccctttgaggtggatcacagcgtcgaaacactggatgaagccactgaagcgctcaggaggataatcagcaagtctaggtggcacacaaagagctcagtcataggacgcccttgaaagctgaagctggaggctctatagaacagtttgtacagtgcggcagcagtctctactatggtatgtgccaataagaggaactccgttccagagtttcgtctactgccaagggcctcgtgtttgtgggtgggttgaataaacacgcaatttgagatgacgctgttttgaccatgaatttagattgaacgcacaacggcaaaaaggattttatgtgaagttgtcgatgggttgaaaaagatgtgaccatctctgacggtctgacctgcttcattcatgaggaattgaggataaagcacatttgaacatgcgcatgccattttgtttttaccaaa

SEQ ID NO: 233 - DNA, 2926 bp, Zea Mays
gtttattttcacttagaaaaatagaaatcacttggtgaaataaggttccaaactagaacttaaaaaaatagagttctaaaactagccctgaccctgattattgaatgaccattgtaccggtaaccatttataatcgtacacccaaaagaatcagacagatacccgttcacccctcgctctcgctgccacttctcccgttcggcctctttttccttccaccaatggaagctctcacagcccgctcctccgtactctcgccgccggggattgccggagacacctcgccctcccttcccctgcccctccgccgagcctccgccgcgtttcttgggcctcgcaggagcccctccgccctcgccatctccacgcgctggctgcgcgctccgcctcgacgcggcggccgcctgctcgcgggggaaggggaagaagtgccccccgaccccgccgatgacgcggctggccgggcggaagattttctagtactcgaggtactcgctgatgatatgatatgttgttattggagatccaacccgtgcaattctgtacctgacgtattgtgctgtacttcagtagtacggagttttgcgacagttcaactgctatgataataaggagcttccatcagtagaacaattggaactattgttttgacatagatacgttatatttccatttgaagatttaaattgcctgtctaacttggcagaacctcagattgtttaatcaacgggaaaatacaataatctgcgaggaattcgctcgtcaagtagtatgtagtatcaattgctgaaggatgactaatttggcaaaatagctttattataataatgaccttttagtatatgatatgtaaccgagttcactaaggacctgtttgtttggttggagttgaattccattctaataatcataatttagacacaaactaattaagttaatacatttgtatatgcaatttatttgtatattatcctaaatcatatgatagagatagttatacactacacttatgctataaaaaaccaagtagaagagtgtgctataagttgtactttagaaaagtagcatgtaaatctatagaatcaatttccatctctcatcccatgaatttgtgataagcttttatataaactttgggaagttatggtttatggaatgccacattctaaaaaatagcctactccattagttagattccaattcctcaaaatcaagggaaacaaacgggtcctaattgatttggtagcttttgccaaagacaaattatagctactaccgcattgttctaaagggaacctgacctctgcataatattgcacggtgttcagttagattgtatttattaaaatttaagctagttcgtcaatgaagtcactttggatgggagttctgcgctacatttttgtgcaggcatctgttactttaattgttcatatttggcctttatctttgccaaaaatattcctggtgggctgattatggatggtggattgacctttctctagatgtctttataagtattgaaagtgatatgctaatgccttaggaggacattttgctttctttgtaagtttgtgtcttcttacttttcgtaattatatttcctttgtaagttcgtcgttttttttcattctccatcttgaacagttgaagtgctttagctttatgagaaacctcaccactaagtcaaagtgatattatgactgtaagcacatgctctttttctttgttatttgtgtgttgatgcctgcagggcaggcctagtgcggtggtgagagctgtctcactgagcagtattcccgcatttgcgggggaaggcttgcctcggtttatccctttgctagaccccactccctttgtgtgttgatgcctgaaaagtcaaaatatcacagtaattaaaattacaagcaactacaattaagtgtacgctggggcaatgaactatggcaatgctcacccactcactcgtaaatctccatgtttttttattggggaaatattttctttcataagctcttaccctttgggcgccgtgacacattcagctaattgttattgctctgtataatttattttttatgagctctccaagattgactattgttctcttcctgtttgtaatattgaaagaataatgtaactctacgccaaagcaatgacatggataccattaaacatgatgatgctggcacttctggaattggtgggagtaacactggtggctctaggactggcctattcagaacacctatttcaggtggtgtgcacagtgcaactgctgttcatgatttaccaccaccagctttggctgttcgcaacctcatggaacaggtgtatttacgctctcctgtgtttggtttagttgtatctgagttagaaagaggtgaacatttaatatggatatgagaaagaacatgtaatgacaatgttcatatttttttaaaccaggcaaggtttgctcatctgtgcactgtaatgtctcggatgcatcaccgccgtgagggatacccattcggttccctagtagattttgcacctgacccatttggccgtaagtaattttaatatcacatcttgtacctaccaagtttctagattgattttttatttatttattgcatttttgtcatgaagacccgatcttctcattatccccactagctatccacacaagaaatttgttggcagacccaagatgcacccttgttgtacaggtaaattttgacaatcgactatactatataatcagctcttgagtgtctttgttgatttcgtactaaaattctgaaccttaggttcctggatggagtgggctatcaaatgcacgagtaactatctttggcgatgtcattccgttgcccactgaacaacaggtttgcactaaaatcactactgatgttatctcttttcctgaataccatctctc

SEQ ID NO: 234 - DNA, 2669 bp, Zea Mays
gtttattttcacttagaaaaatagaaatcacttggtgaaataaggttccaaactagaacttaaaaaaatagagttctaaaactagccctgaccctgattattgaatgaccattgtaccggtaaccatttataatcgtacacccaaaagaatcagacagatacccgttcacccctcgctctcgctgccacttctcccgttcggcctctttttccttccaccaatggaagctctcacagcccgctcctccgtactctcgccgccggggattgccggagacacctcgccctcccttcccctgcccctccgccgagcctccgccgcgtttcttgggcctcgcaggagcccctccgccctcgccatctccacgcgctggctgcgcgctccgcctcgacgcggcggccgcctgctcgcgggggaaggggaagaagtgccccccgaccccgccgatgacgcggctggccgggcggaagattttctagtactcgaggtactcgctgatgatatgatatgttgttattggagatccaacccgtgcaattctgtacctgacgtattgtgctgtacttcagtagtacggagttttgcgacagttcaactgctatgataataaggagcttccatcagtagaacaattggaactattgttttgacatagatacgttatatttccatttgaagatttaaattgcctgtctaacttggcagaacctcagattgtttaatcaacgggaaaatacaataatctgcgaggaattcgctcgtcaagtagtatgtagtatcaattgctgaaggatgactaatttggcaaaatagctttattataataatgaccttttagtatatgatatgtaaccgagttcactaaggacctgtttgtttggttggagttgaattccattctaataatcataatttagacacaaactaattaagttaatacatttgtatatgcaatttatttgtatattatcctaaatcatatgatagagatagttatacactacacttatgctataaaaaaccaagtagaagagtgtgctataagttgtactttagaaaagtagcatgtaaatctatagaatcaatttccatctctcatcccatgaatttgtgataagcttttatataaactttgggaagttatggtttatggaatgccacattctaaaaaatagcctactccattagttagattccaattcctcaaaatcaagggaaacaaacgggtcctaattgatttggtagcttttgccaaagacaaattatagctactaccgcattgttctaaagggaacctgacctctgcataatattgcacggtgttcagttagattgtatttattaaaatttaagctagttcgtcaatgaagtcactttggatgggagttctgcgctacatttttgtgcaggcatctgttactttaattgttcatatttggcctttatctttgccaaaaatattcctggtgggctgattatggatggtggattgacctttctctagatgtctttataagtattgaaagtgatatgctaatgccttaggaggacattttgctttctttgtaagtttgtgtcttcttacttttcgtaattatatttcctttgtaagttcgtcgttttttttcattctccatcttgaacagttgaagtgctttagctttatgagaaacctcaccactaagtcaaagtgatattatgactgtaagcacatgctctttttctttgttatttgtgtgttgatgcctgcagggcaggcctagtgcggtggtgagagctgtctcactgagcagtattcccgcatttgcgggggaaggcttgcctcggtttatccctttgctagaccccactccctttgtgtgttgatgcctgaaaagtcaaaatatcacagtaattaaaattacaagcaactacaattaagtgtacgctggggcaatgaactatggcaatgctcacccactcactcgtaaatctccatgtttttttattggggaaatattttctttcataagctcttaccctttgggcgccgtgacacattcagctaattgttattgctctgtataatttattttttatgagctctccaagattgactattgttctcttcctgtttgtaatattgaaagaataatgtaactctacgccaaagcaatgacatggataccattaaacatgatgatgctggcacttctggaattggtgggagtaacactggtggctctaggactggcctattcagaacacctatttcaggtggtgtgcacagtgcaactgctgttcatgatttaccaccaccagctttggctgttcgcaacctcatggaacaggtgtatttacgctctcctgtgtttggtttagttgtatctgagttagaaagaggtgaacatttaatatggatatgagaaagaacatgtaatgacaatgttcatatttttttaaaccaggcaaggtttgctcatctgtgcactgtaatgtctcggatgcatcaccgccgtgagggatacccattcggttccctagtagattttgcacctgacccatttggccgtaagtaattttaatatcacatcttgtacctaccaagtttctagattgattttttatttatttattgcatttttgtcatgaagacccgatcttctcattatccccactagctatccac

SEQ ID NO: 235 - DNA, 9287 bp, Zea Mays
cccgagcgcgcgactccctcccgcctcccagatcttccagaacccgctacgattcgggcaatccgccggcccgcgccctagtaggtctccgcgggcgggattggttgatgcctccccgcctcgcgtgaccgctgcccgagggctggaccggagatctccgcatggatcacaggggcggcggcggcggtggcggaaacaagaaccgcaccgatctcctcgctgcagggcggaagaaggtaccgactcccgcgaatttgtgctccatgttctcttttgtgtctttttttcggggggattttgatcgagcgttacgttacgtttacggtttacctcgcgtgcagctgcagcagttccggaagaagaaggggaagcggggtcccggcaataaggccgacgccgatgctgacgcggaggccggggagggggcgcccaaggcggcggaggagtctgtgcccgagccgaaatcgcctgttgggttgaagctcctcgccggggagggcggcggcgggagcactccatttgaggtgaggttcgagcgcttcagtgtgatggcgtgggttttgagtgggctgctcctgctcctagctgttgttgttgctgggtgtgtaatgcatgtctgtcaatgcaggaagcggagaggtctcaggcggagcagtgcaacggtgaggggcctggtaccgcggagtccagctctgtggagagttccaatgcggtgcaagaacaggagacggtgcaagagcaggagacggatgatgtctccgatgcacatcatgtcggtcctagtgagcaggggatttcggagcatcctgaaagccagacagctggtggcagggatctatcacttcaggctaccagtggagacagcattggtgatgataatgtaggacgagctcagctgggtgatgtggatagcatggagctgaatgcttcttctgaaggtaatggagcagatggtgattgcaatcaactaggggaacaccagcaggtggaaatggatgctgttgaaaggccaacaagttccagtttcgaagaattcaccgagttgccaattcattctcaaggcattgaagccgataatatccacggtgaaggggctcaggaaatggtgatggatgtttctgggaggccattagatggagacatacagcatgacatcgagcccacagcttctgctgaaatagatgccgagactgcacttgaagagtcaactgttgcagcttcaattgtgattcctgagagtactgcaagaggtactgagtacgaaagagacactgggtatgaaaccgatggagtagacaaagaggctctcctagaagatccaagcatggtgcatgtaagtgatgaagctgtcactatagatgatttgagtgttcaggccaagccaacagcatcagcggatatgccactttgtgagcagaagggggatccagctttatctagaagtgcggtattgcaaggcattatgccacttcacttcgaggatatacaaaatcatatgttctctgcaactctgtcaagggattttctccagttgcagctagatgaggctgctggcctttattcagattttacacaacagtcttctgacaataccacacagctccgggtactgctaaaagaaactgaagaaagcaaactagcagttgacagagagcttcatcaatgtagacatgagctctccaaggtgaacatagaaaaggggcaacttgaactgaccatggcttccttgaaagaagaaatcaacactagcaacacgaggtgcacatatttggagagtgagctacattcctccaaggagagcacagaacaaatccacagtgaactagctaacagcagattgttactggaagctctgcaaaaagagaacatggagcttactgcaagccttgcttttgagaaagaagccaaaaaagaagttgaagaacagcgggaccatctatcttctgataacaggaagcttttatcggagttgtcaggtcttgagcttagcttagcttctgtgaaagaggaaatggatgctagcagtagcagatgtaatgtttttgagtgtgagctgcgttcctccaatgagaatatgaatcatactttgacagagttggcaaattgccaggctttattggaaacattacagaaagataatttggagctgtctgcaaattctgcctccgaaagagaagcaaaaatgaaactccaagaagacaatttgtatctatgtaatgaaaagggcaagctttcttcaaatttacgtgaactaaatgacaagttggaagtttcgtatgccaagcataagcagcttgagtcacatgtcaaagatacagaaacatactttggacaacttaccgagcagctaattgaggaaaatctgtacacaagtattagcatcgatatttaccaatctacaaccaaagacttagacactaagtacaatattgtgctgggacaattccagaatattatgcgtcaagaacttcatttggactcgtctgaagtcactactgagaatgctgaaagagccattatgacccctagacatgatagccatggtaataatcagtgtttgcttaatctggtaaatgcgaatgactcatgtaactcaactgctttgctgtcgctgaagggccatctagaggtggcaaaaagtgatttgcataaccttgaaaagttgctagagaggatctcctctaggtctgatggacgtgttctggtatcaaaactcattaaatcctttgagtcaaagggaagtgacgatgatactggactgtctgagggggagcatgataatttacaaaagtcaactcgggagatgctatcatgcctaggggagaagtttatagcaatgagctcagatattacaaaaactgaagaatatttggctgaactgtgtaacaaaattgaactttacgtcaagtctactgtgcagcatgatagagatagacaatgtactgttgttcttgaggccaaaatggatgaacttgctggcaagctgagcaactacaaggagacaattgacaatctgcacaatcaggttgctattgtgcagcaggatgcaaacagtaatgctggaaagctcattgatcaagcagaactgttgcagaaggatgcggtagaaaggatttccattcttgagaatgagagaatgtctttatcagatttactcagtgaagtaacaaacaagctcacctctttgggagatgctgtatttcctagtggttccagtgaaattgaaggtctcaatttctgcactttgagctgtgtggaccttgttgctagatcatttcaaagtcttcaggagaaattagaggctgctcaaatagataatgctcagctcaatagttctctggtggagctcaggaaggcaattggtgttgctcaagagaggagtgaacatgcagatggaattgtcaagaaactgtatgattccctacaggaacttctatgtgattcacttggaagttcaaatgaatttggggccagatatagtgttgaggaaccaattgaaagtcaatatggaagactcattgcgcatttaaagaatttgttgcatgaccaccattccgcgctgtcaactaatgctgaacttgagttgagtctgttaagtaaatgtgaagaagttgaggagctcaacatgagatgcagttctctattaaaaaaattggatgaagtttgtattctaaatgaggagcttaagtcagcttcttcaagtaaaaacgtcacactggataaactacacagtagatgccttactgtagcagaaatgttggcttcatgctcagcaaatcattcctcgacagttcagttgatatctgatattggtgaaggatctagcaaggaagatcatattcttaccacccttctcccatgcattgaggcggacgtggcttcatgcatcgagaaatttgaaaatgcagctgaagaaatccgtttgtctaagatatgcttgcaagaaatcagcatatttgaccagatttcatttgaaaaatggtcttaccccttgcccacattgattaaagaggaagttttaccaaagatatgtgatttgcaagacagattcgaccagctcaatgcactaaacattcagctggaaactgaagttgcagtcctcaaggatggcatgaaagagctggatgaagatcttggaacttcgcgatctgagcttcagaaaaaggtttctgaacttgaacagttagatcagaaattttcatctgtgaaggaaaaacttagtattgctgttgcaaaaggtaaaggtttgatagtgcagcgtgacagccttaagcagtctttgctggagaagtctggtgagatcgagaaactcacacaagaactgcagttaaaggaaacattgctgaaagagttggaagccaaactcaaatcctatacagaagcagatcgaattgaagccttggaatcggagctgtcatacataaggaattcagctacagctctaagggattcatttcttctaaaagactctgttcttcagagaattgaagaggtcttagaagaactagatttgccagagcaatttcattctcgagatattgttgaaaaaatagaactgctgtcaaagatggccattggcactcctttcactctacctgatggtgataagggatcctctgttgatgggcattctgagtctggtgtggctatgaatgtcatagacgatgagcagaactcaaattcaaattcagtatctgatgaagtaaagagcaaatatgaggaactgaataggagattctgtgagctggctgaacagaacaatatgctggaacaatctctagtggagaggaacagtcttatacagaaatgggaagaagtccttggccaaattagcatccccccacagttcaggatgttggaagcagaagataagttagcatggttaggaaacagattcttggaggtggaacaggagagagattcattacagttgaagattgagcatcttgaggattcctcagaaatgcttattgctgatctagaagagtcacataaaaggatatctgaactcagtgcagaggtggttgctataaaggctgagaaggatttcttttcacaaagcctagagaaactgagatttgagttccttgggctctctgagaaagttgttcaagatgagtttgttagagataaattgcgaatggatctatctgaactgcgggataagttcgctgaaaaaaccgaggagagcaggcactaccatgaaatggacaccgaggtccacaaactgctgaatttggtgcaaaacacattgcaggatagcactaactctgaaatttcatctggaggcatttctgctgtgttgtgcttgggcaaaatgctgaagaaacttttagatgactatggcactcttctgtacaagtcgactgaaggcaattttgccgagagagacattcagttagaggatatcaagccatctaaggatgcctctaaatcggacactggtgcatacgagaaagagatggaactaaattctttaaataacgagttagatcatgctcacaacaatctggccttagcgcaacaggagtgtgatgaagctgtggagaaggcacaatcactaatgatggaaattgagaccttacatgctcaaataagtaaattgcaggaaagtgatgctgaacaaatgcaaaagaaagagatggaactaaattctttaaataacgagttagatcatgctcgtaacaatctggccttagtggagcaggagcgtgatgaagctgtggagaaggcacaatcactaatgatggaaattgagaccttacatgctcaaataagtaaattgcaggaaagtgatgctgaacagatgcaaaaatatcagtcgcttgtccttgaactagaaagtgtgggtaagcaacgggacaatctacaggagcggttaaatcaggaggagcaaaagtgtgcctcattgagggagaaactaaatgttgctgtcagaaaagggaagggtctagtgcaacacagagacagcttgaagcaaactatggaagagatgaatgtagtgatagagaaacttaaaagtgaaagaaaacagcacatagaatcacttgagaccgagaaatcatcgttaatggatcgattggctgagaatgaaaagagcttgcatgaaacaaaccagtacttgagtggactattaaatgctttaaatagagtggatgttgctcgggaatttgatatggatccaatcaccaaggttgaaaagatggctaaatttttccttgacctacagtcaacagtggcttcatcgcaaaacgaagtgatgaaatcaaaacgagcaacagagctgcttcttgctgagttaaatgaagctcatgaaagggctgacaacctgcaggaggaattggtcaaggcagaagctgcactttctgaatcttctaaacaatacattgttacagaatctgcaagagctgatgctgttcgtcagcttgaacttattatgcatgcacagtcacaaacaaggaggaggcaagcagatcatttgctggagttaaactccaccagcagtcaactaagagaagtctgctttgaactttcacactgtcttgttaatacattcagtaaggatgtggaccttatctgctatgtggtgaacttcatgaggtcttctggtaaattgatggatgacacaaatacgatggacataccgattgcctctaaacatgttttgtccaaccgcacaaacaacaaggtatattatgctctatataagtacgttattttaatgttttgcttcatttcgaatactcacaacttctttggattagcaaaatttataccattttgaaggttgacctgtatctacatattgccacatgtatatcgaagacatgtactattgctcattaacttgccttttttgcatagttagataaactgtagcctatttttctttattaaatgaaatatgtattatttaaaagtaatatttatatatcgaatacagccttatctttatattttcttggttcaccatggaagtcatcaatttccttggaatgtgtatttccatccatagtaaaatggaaaattaatggcaccttgccttttcctgtggtgaaacaacagtacacacagatgttattatatgaaattcaaagagttgccttttgatttgtggcaaatcctaaccgctttttaattgctctttacagaaggctcatattccaaatgctcctttggaaattaagacggatgatacggatgacagtcagtttttgcatcatcttgctattgcatgccatgctttatctgattgtgttaaggactgtaatgatctcaaaagaaacattgatgagcatgacttttcagttgaacagaaagcaaccgagctatttgatgttatgtccaccttaaagaataggttcacttctcagcataatgagttggaatctttgagagcaaaatttgttgaactacagtcagagatggaagaaagagacaaggagattatatttgcacaaaggaatatgagcttgctatatgaagcatgcgcaagttcagttgctgagattgaaggaattagtgatatatatcctggtaaacacagctatgctgttgaacattctgcagatgaatgtataaaatcaatcgttgaacagttagttatggctgtaaaaacttctcagaacagtaacgaaggtagcacaaaggagctgaaggctattgttcttgagttgcagcaggagcttcaagctaaagatgtccaaattagcacaatcagttctgatctatcatatcagttaagggtggctgaatcttctgcaaagcagttctcagttgatcttgaagatgcaagaatggagctccaaaatttggagaaacaagttgatgtgttgcagaatcagaagaaggatttagagactcaattaaatgagcttaaaaatatggaatcaatggcaagtgaacaacatggaagaattgagaaattgactgatgaattaagcagaaaagatcaaggtgagctgtcagaacattttggttcaattacttgtgttttggtcactgctacacattttcatgtaattttaaataacaaaaaacatttgttcctttgatttatatgctttttatatgttccgcagaaattgaaggtttggtgcaagcactcgatgaagaagaaaaagagcttgaaatcttggagaataaaagccttcagttggagcaaatgctgcaagagaaagaatttgccttgaagacctcagaagtttctaggaccaaagctttggcaaaacttgcaacgactgttgacaaatttgatgagctgcatagcttgtctgagaaccttcttgctgaagtggaaaaccttcagttgcaattgcaagaaagagattctgagatctcatttctgcgaaaagaagttacaaaaagcactaatgaactgctaaccactgaagagagcaacaaaaattattcatctcagctaaatggtttcatgaagtggttagaaagagaactgttgcagttcggcttccattctgagagtgccaatgattatgattacactcaatttcctgtctatatggatatgttggacaaaaaaataggatctctgatagccgaatcagatgatttaagggttacagttcaaagcaaagattctttactacaggttgagagggccaaaattgaggagttgatgcgtaaatcagatggtctagaagcttcattgagccaaaaggattcccagatagggttacttcgccgggacagagcatccaatcagcagagcagatctataaatttgcctggcacttcagagattgagcaaatggtaagtatgttttattttgtggatataaaagtacttgattaatatgcattggagtagtttatttatgcttacttgcatattcaatttgggtgcagaatgacaaagtaagcccagctgcagttgtcactcagattcgaggcgcacgaaaagtcatcaatgaccaagttgctattgatgtagagatggagaaggacaagccttttgatgatgaagatgatgacaaaggtaagcatatgccctgcatcctactccatacagttttgcacttttagttttgttctcagattgatttcacattggtattgcagcccatggtttcaagtcattgactatgtcacgctttgttcctaaattcactcgaccggtatcagacagaattgatgggatgtggtaactgcaatctcaattgttaatttgttactttactgattactgattcgtgatgttttggtggagtcactaattttctttttttcttcttttattaacagggtctcaggcgatagattgctcatga

SEQ ID NO: 236 - DNA, 1313 bp, Zea Mays; identical to SEQ ID NO: 51

SEQ ID NO: 237 - DNA, 2149 bp, Zea Mays
cagtaataatgaaaatgggcggttcatttatggagttgcgagttctcctggtaaaagagcatcgatggaggacttctatgaggcaagaatagacgacgttgatggagagaaaattggaatgttcggtgtatatgatggtatgtattcgctagcgacatctgaagtgatatcaattcccgcggttttcctaatgccaccactctctgatgaagttggtagtttgagttgtaaggttgagggcatggttttctgtttctgtaggtcatggaggagtccgagcagctgagtatgttaagcagcaccttttcagcaatttaatcaaacacccaaagttcatcactgataccaaggctgctatcggtactttcatattagcttaactattgtagacttttgacttgtacactgagatatggtgatcttgatacccttgtattatttttgctgcagccgaaacttacaacctcacagattcagaatttctgaaagctgatagctgtcaaactcgagatgctggctcaactgcctcaacagctattattgtaggtgaccgtttgcttgttgcaaatgttggagattctagagccgttatttctaaaggaggacaaggtaagtttctcgttggtaacatgacatatctcaatgtcttttcctatacttccacatgtatcggaaactttcaaattattatatgctgtgtattttcctggacgagtatttccttgtgacgaatggataaactgaatatcaggattccaagctaaccacgttccacttgtattcgatattttttgttatgttttccccatctcggagctgcagcgattgcggtttcaagggatcacaaacctgatcagacagatgagagacaaagaattgaggacgcagggggctttgttatgtgggctggtagtgattcctctgattctatctataaaaagaaactatcttatcttaatatgtgccattactgttgcttctactgcttgatttttcgaaatttgtagggacatggcgagtgggtggtgttcttgctgtctctcgcgcatttggtgataaactcttgaagcagtatgttgtcgctgaccctgaaatcaaggtttgtcatgcacttatgttttattacggattgtcgggatagtttttcagacctatcatggtttgagggaatatggtggggttgtaaacttgtaataagtgcctaaaaatggggattccatcatttagcaatgtcatacatcacccacaccccctgtagccatctgaaaacgatttttgctgttacaatcaggaggaggtggtcgacagctcccttgaattcctcatccttgctagtgatggactctgggatgttgtcactaatgaggtacctacagatattgctaaatatattcattcagtgcaattggtctgtctgtcactcttacctgacgttatgtatttttccaggaagctgttgccatggtcaagcctattcaggacccccaggaagcagcaaacaagcttctcgaagaagcgtcccgaaggggaagctctgataacatcaccgttgtcatcgtccgcttcctatatggaactaccggtgataaatcaggcgcagacaaagagaccaccaatgaccaaaactcctaattacctcctgtagggatccctcatgcgtgtgttttcttctggctgttgtatctgatgctcaaagtagatgctccgtgtgtcttccgctgctgttccgcaaggaaactgactcccccgaccgtcgtcgtgatgctgcccgctcatgctcctagacgggaatgactgccgcagaatgacgaatagggctggtgtgtgttacagtatggtcctttacccctcctttccattaagctctgtgatgtagctgtccgtgctgttgattcatgagatcatgctagagatttttcctggcagtgcgtgtaaaactgtcgaactatttgaacgaaagttgtacactgcagtatgtaacaatctcctagatccgccttttgtggcgtcctgctgtcatgcacctgaatgctaccaagccgggacggaggtgagctatcggtttactcggtgtacagaaacgggaaggtcgaatttttacagagcaagtgcgtggattatcatattaatgtgcaaataaactgttaca

SEQ ID NO: 238 - DNA, 2149 bp, Zea Mays; identical to SEQ ID NO: 237

SEQ ID NO: 239 - DNA, 1192 bp, Zea Mays
atatgtgccattactgttgcttctactgcttgatttttcgaaatttgtagggacatggcgagtgggtggtgttcttgctgtctctcgcgcatttggtgataaactcttgaagcagtatgttgtcgctgaccctgaaatcaaggtttgtcatgcacttatgttttattacggattgtcgggatagtttttcagacctatcatggtttgagggaatatggtggggttgtaaacttgtaataagtgcctaaaaatggggattccatcatttagcaatgtcatacatcacccacaccccctgtagccatctgaaaacgatttttgctgttacaatcaggaggaggtggtcgacagctcccttgaattcctcatccttgctagtgatggactctgggatgttgtcactaatgaggtacctacagatattgctaaatatattcattcagtgcaattggtctgtctgtcactcttacctgacgttatgtatttttccaggaagctgttgccatggtcaagcctattcaggacccccaggaagcagcaaacaagcttctcgaagaagcgtcccgaaggggaagctctgataacatcaccgttgtcatcgtccgcttcctatatggaactaccggtgataaatcaggcgcagacaaagagaccaccaatgaccaaaactcctaattacctcctgtagggatccctcatgcgtgtgttttcttctggctgttgtatctgatgctcaaagtagatgctccgtgtgtcttccgctgctgttccgcaaggaaactgactcccccgaccgtcgtcgtgatgctgcccgctcatgctcctagacgggaatgactgccgcagaatgacgaatagggctggtgtgtgttacagtatggtcctttacccctcctttccattaagctctgtgatgtagctgtccgtgctgttgattcatgagatcatgctagagatttttcctggcagtgcgtgtaaaactgtcgaactatttgaacgaaagttgtacactgcagtatgtaacaatctcctagatccgccttttgtggcgtcctgctgtcatgcacctgaatgctaccaagccgggacggaggtgagctatcggtttactcggtgtacagaaacgggaaggtcgaatttttacagagcaagtgcgtggattatcatattaatgtgcaaataaactgttaca

SEQ ID NO: 240 - DNA, 303 bp, Zea Mays; identical to SEQ ID NO: 65

SEQ ID NO: 241 - DNA, 575 bp, Zea Mays; identical to SEQ ID NO: 66

SEQ ID NO: 242 - DNA, 984 bp, Zea Mays; identical to SEQ ID NO: 67

SEQ ID NO: 243 - DNA, 1395 bp, Zea Mays; identical to SEQ ID NO: 68

SEQ ID NO: 244 - DNA, 5520 bp, Zea Mays
atggcctcggatccaaccagggaaggaaggaatccaagccaccccagtccgctgcttccattccatctcccttctctcgccttctgcggcactgcagtgctctgctgcctcggcgtctccacctcctcccggcgacggcagggcatccgatacgacgccgcgcttccttccgaatcccaagccgcaccccgcaccctcccggtcgccattcccgatgctggtgttctcgagcgacgacgactgctgcggctcctcgtactaggggggcaggatcgatcggcaggtgacgtttcgttcgttctgctgttcggttcgaacgggagagtttgcttgggggttggtgcatcggtttcagaacgaccagttcattagttttggggattggggctatttcttgttttttttaaggcaggagagttgcttttcattctacgtattcgagagatgaaaaaaaagtgttttttgggctagttttgttccaatgatttggtagcaattaccatggcagttgcacgaaagggattcatgtactgggtctgaacggtttcatggcgatgcagtttccatcaccaaattcaccgtgagatgtctggtactcgttgtgactaactcagtaggcagtctgtcagttaagccaggtaaactagttactagtacttgacattgccactgtattttttgtaattactagtaccatttgatgagaagtggtactgagttttatgtgggtagacgaacgatgtcatcgcactcccttctcagtgtcaacgatcatgggtggcatgacctgtgggctgtggagggcggtcccggtccccttcgtttggcttatctggaaaatgctggttgcgcgtcaaggccatcttgaaccttggaaaaacgctgctgtgtctatctttcctgccttcctggttccgtccgtgctgtgctgacatgcgtgtcgaattctcgctcatttggttaccggtagtggggtcatgtcggatattgatgtggaagggggagttggtagtggcaccccctccgcctcggacctggcttcttctgataccggctctggagctgggtaatagagcgcagactttgggtctggaaagcgattgtggttatcgttacgacaagtatgctaggtcaaaactgtttttgtatgtagttggttcacagatgccaagggccgatttatttgtttgtttgttgctcatgttgatgttctgagcataccatttttcagatgtttatatttcatatctgataaagtttataagtttattgtcgtcattaagatgggttaagaaggatgcctgctgtgttttaggatgaggctccatttggaagtcaatagtgcaacactgctcattccaatgatatacccccactacaaacagacacttggtcataattggctttcgcacattcatattcaatgtctcaaacttgttattacgattctgcggatggtctgacaaaaccctgggcatagtgtgattattgacactaatattagttccaaagcatttcattgagtaaaaagaaataatcattctcaatatgtccaggtgcatatttctgaattttcttgctcactagttgtctgtatccatcctctaggttttattgtttactgacctttaccagattgtcccacagactcgcagaactataggatatcacagaacagttcttgaggtacttattgcagcctaatagtacatggagcgatattcagatatgagaccaaaggcagaagtttcatatctcggaaggggttccagattctcttctagaaatcaaagttcagaagagaggactaaccatagcagcgataaaccgggaagcagcacaagattcaatcctacgaaagcgagaattggcggtaatcaagggaggccaagatatgtatgcgattcatttaaatctccaagctcaaaggtgtcgcctgcaggctcttccaaatttccacttagcaagtttgaggagaggcgaagacagccttttgtgccagggtttgacattgctgaaagtagtagaagaaaggctgatgccaagcagctacagggtagtaagaaaattgctgcagagaacgacagttcagacaatctgcgaggtgaatcagaaggttttactactgaacaagtagtaaaaccagaaggctctcatgttgtcggtcattcaggtgtttctgcgtatacagtcgggtccctggtccaaactgcttcactaggttctaggacacacagacagaaacacaaagaagtgaatttgggtactccaggagcatcgtcttcaactctgactaacaggtctactatacctggaaattctaccatgggtgtgaggccagcttatggtcatgttaatggagggcagatacatggtcttaaaaaccttggttgttcttcggtacctgatgctcagccatcaggttgcccatctgagtctgttattagtaggaggaggtttgagttcatgagaaagagggcctttgaccaggaaagctcttccagatcagtgaacttaagcttaggtcattcaactcctacagatattcgcagaatcagaatgaatgaacaatcactttgtcaacaaataccacgaagcagcagcagaagccatcaggaatcggcaggttcagttaggacaagacgaccttctcctcatgccactaggatgagtgttcctgatggaagagcagatggcgtgctttctctgcacgagtcatccacaaaggatgtacagccagctcaggaacatctttcattggaagaagtctccactgagagttcaataaggccattctttgtggaatttgataataacattttctcgtctagtcatcttcgtcgctcgagtactcgagctgaaaggggaagaccaagctccctttttgaagaaagtcctcgacaaatgttccatagtctcatgggggagagggacagacatagacacataaccatggaaggaattacagaggttgctttctaaaatgtttcctatactggttccagttgttctgttttcgttgttagatcttatgccattataatccagttaaatatatagtgatactggtcttgattttgataaatatccataactttgactacgatggtggtttaagtgtaacattttggaatgaaataggtttattttctgtaggttttggctgcattggagaggattgaacagcaagcagagctgacctatgatgttagttcttttttaccctttgctccacaagtccgttatcatgtttcttttgcctgaaactttgaataaacttttttttgcagcaattgctaatgctggaggctaatctattttttggcgcctttgcctcctatgatcggcatagagacatgcggatggatattgatgatatgtcctatgaggtactatcttttatcgtgtcttgtcctgcctgaatggtggaggggttttattagaagatgctttttctttctggaggattcttccttattctgtgtttgaatcccttgctgtgatttgagcactaactacaatcctttatgaaatactcttggttcatattcatactcacgaaagaggtgcttgtatcttctgaacaggaattattggccctggaggagagaataggctctgtgagcacagctctttcagaggagcagttcacaaaatgcctcaaaagaagcatatatagtcaggtcgctctagaagtgaacaaatcaaccgttgatgacatgaaatgcatcatctgtcaggtaagcggtaaccttacctagccacctaggggatctgctatttctgttattctgctggtataaaacaaaatgcatatgaagattttacattgagcactttctttccaatgtagaactgacctgttgtgtgggacagtcggcgctatgtagtcctggttttgcctgtcattctcacagaagacaggcccttttatgctgctattactccacttcccaaacgtcttattaaaaaaatgtaattgattactggcagtgtttttttttgaacgtctaagggtgtgtttggtttggcttttgggttttggcttttgcctcctaaaagccaaaagccaaccaaagggttggattcaggaagcagatttttctaaaagccaactttcttgtagtgcaaaactgaaagcacccttagacctgcttttagcggcttttggatagaactataaaaacatatatagaagaacttttaacgacttttagtggttttcaccaaacggtttttagctttttaacagttcacagcctacaacagctttttccacagctcacagcccacagcaactttttccacagccacagcccaaccaaacggaccctaagtctctgcttttctttgggaaatttggatccataccattaaaagatcactactttggatccataccattactatctcacttacatgtgggtccacatgagtcaatgacatgtggggtccatggtatatatctaaagtttggatcttttaatggtatagatccaattgttgcttcttttaaacgaaccatagagaagcctgttttccagaaaccgcaatcacagaggttcatttctccaacatcagtggtaggccgtaggcgtctgtcagactacgctccgttttgcactttactgcttttctttccagcgttgatgtttttaggatttaaattttttttcagtccttttcatgtccatagccaaagaaactggtgcagaaaggttctgttatggactactgaaacttgaaacatctctgtctattccattccaggaagagtacgcggagggcgaagaggttgggaggctgccatgcgagcaccggtaccatgtgtgctgcataggccagtggcttgggcagaagaactggtgtccagtatgcaaagcgtctgccgtgccttccaagggctgaagcattggggatgctggaaaccccgttccggattacaaaccatccttgcttttgtctacgtacattgttcttttccctatatgcattagatatagatcatgtctagatgtatgacgctagaacagcttgcgatttgggaggaagctaagagagtaatagttagctggttaataatagttcatagctaatatttgctagataactattacttggctacctattagctgtgcctttcacattgtggtacaggacaaatgcttgtcagatcgtgaacaaccttataacttgatgaatggcctaagtcaaagaggaatatgttgtgccaatctcaaccctatgctctcttcgtgtagtctgggtgtgtttggttgcgggacagtcaagaaagggacgttccctgacgttctctctcgtctttctgattttgagggataactggggataacactgtaatagttctgtttcaacccttgatcttgaactaaacaaccttatttgagggatcatctcatcttatctcgtcctgtcattacaaccaatcttgttagaaaataaaaaatgcggtagagatggtatcatagtagttgtacataagacagttcaatctattgt

SEQ ID NO: 245 - DNA, 5429 bp, Zea Mays
catctccccaaagtcccaaacgcctcgcctcgccgtcgtcgtccactcgttcgtcgctgctccctcctccaccaccttccagtcctgtccagtgccgccgccttgccctgccctcccctcccttcccccgattaccctcgcggttgacctcgccaatccggtcccgcctccgtataaatccgcccttctcgcccccgctccgaccacaaaccctagcggcgcgccccggcatgggctagggttcccgcggcgatggagtgggacagcgattctgacggcggcgatgacgaggaggaagaagaggtccgccccgggggtggggacgcgggcccggggttctcgctggccatcgagggcgtgctgggcgcgtgcggcatggtggtctccgacgcgctcgagcccgacttccccatcatctacgtcaaccgcgggttcgagagctccactggatacagcgccgaggaggtgcttgggaggaactggtgagccgactgacctgccggctcctgtttcgattcgataaccacggggtgggggatttgttcgttgctagaggaggcgcttggggcgcgtgattcaccacgggaggtttttatagcgtgtttggttcatggaatgacaccggggggagtcatccgaacctcggtgggttgtttgttttggcaaggggaaccaacgcatccgccatgagatcgcaccctccgccagtatattcacggcatctactcgttcctcttgaaatagtcggtcgaacacatgctggacgcactgatgccagacggggtcattccccaaaccaaacagcctatgtgcttgttgctgtttcgtggtgacttcagcagtattccgtagctcatagctaatatttgggtctggaatggctgtctcgaatcaaatcgtggtgctatttagctgctttgctaggttaaattgctaaaatgcagttttatttcttttctggtgttattagtttaagctttctgaaccatgattaatcaaggtttccatttgcatgaattactgcagcaaccatagtcaagatggtgtttggtgtatatgacatgttgcttctagattctccttagagagtgtggtttccaaaaaatggttggcccaaatcgattttataactcctaatccatcaaattgtttgctagggagtgggaatctaagatgaaaacaatttatttacctcttgaaattttatcctagcataagtagcaagggagaatattttaaggatgtttacacttcttcacagtttgacatacacaaagatttaaccttatggaaaacagctattctcatgaccaaaccttgatttgtagcttctgttgggtttcaactctagcctaccccaacttgcttggggctaaaaggcttttttgttttgttgttattgtacacttcttcacaccatttggaaggaaaatgatctatttgcagcctagaacgatgtttcacatgagtcaagtatcccttgagaattgatggagctggtttatttttcttgaacagtgtggattcaatcgtttactgaagctagtttctaaaatatttgtatagttcagtctggcggtgacaaatcacatacgttgatgatatgttcctttccatacatgtttcatcttctggctccaatttgcacacttcctcttaatctgcagattgctattgtaaaaattttattggtcttttagaaccactcagtttgcagagtgatatgtaaagggcaggcttgatgcagttgtaagaggtgtctcactgagtgaggctcgccttggtttatcttccctagagccactcatgtcagagcctccggcactggctctgcccttttttagaaccactcagcatgctggccagcctacttatgctttcgttctcgattcccataaaggggttaacacagggttgctcagttggtgttatagaatctactctagaagacttgtatgttggtccaactcaccctcagcctcaactacctaggtgggactaaaccccacaatctcacaaacacacacatgtgccacaatggaacaaatttaaataaatttggccagatgtctcaagaaagatttagtaatacctggccggcacgatggtcaaggttgttgacggcatcagcaaaagcagaatcctactcttttaccttagaaaagaagttatgtgctgaccacaatatattaccagtggtagactggtactggtaactaagttcttttaccgtctgtttggctagctgcacctgcacccgtggatcttcaaagcatgtcgtgtttggttgagtgacttgtgcatccaagccgagcgcatggaaattcagaggtcgggccaggctcgctacatacgcccgcgacctgcgtttgagcggatgcaggctgacggcatgcacctctctgccatgagacggattccaaaaatattctctttagctttttttaccatatctcttagttcaaatatccaatcactaaactaattttagatatatgttcttaacatttttataaacaaaactagaccacatttgttatataaatattgaagatttatttatttattttatttgatctttgttctgatgcaaacaaccaaacactagctatatccaacctgaatatactaatgctaacaaccaaacaaaagtctacgcatgtacctagccaggacataaggagcttgactctttacatactggccaagccggaccagtctgctacgataccacaaccaatcacatagttagagaccaaatagaaatgccttaaggggttttaattgatatatgaaggggggttgattgcttgaacagttgtataggaaagcataaaaagcttagttgccatggaaattatagttaggaattagtggtagaaactagaaataactgatcagtcatgtggttcatacatttaaggcgcactaaatgtaatctatagtatcagcagtagttaaataatgaaggcaccatgaacttctgaacataccttgcttacttttactcagctgctaatagaagagggtaagttccatgtttgctagttctgttgacgttacatttttttcttttgtatatttctgttgcttctgatcaaatgtaagaattttacatggtatgctagtcagtttactagtacaatgttcacttatgtcttattttaagcctatttttaatcgttttgatgcttttttacagccggttcctacaatgcagaggaccatttgctcagaggaggcatccccttgttgatgcagcagttgttactaggattcggagatgtttagatgaagggactgaatttcatggtgatctgttaaattttagaaaagattgttctccatacatggccaggctgcaattaacacccatatacggagacgatgaagtaataacacactatatgggcattcagtttttcaatgattctaatgttgacttggggccatcttctggctctgtgacaaaggaacttgcaagatctacatggattgcacctggcaacactgactcaccaactccagtaggcaagggtaatttgtgggaacattctagtctctttctgctgagtgatgaggtaatttgccagaagatcttgtccaaactgtcgcccagggatatagcatcagtaaactctgtttgcaagcgacttcatcacatgacaaggaatgaagacctttggaggatggtttgtcagaatgcatggggcactgaagctactcgggcccttgagactgtggcaggatcaagaagtttggcatggggccggctagcacgagagttaaccacccttgaagctgttgcctggaggaaattgacagtcggtggtgcagttgagccatctcgctgcaacttcagtgcctgtgccgtagggaaccgtgttgttctatttggtggagagggtgttaacatgcagccgatgaatgatacatttgtgctggacttgagtgccagcaagccagaatggaggcacatcaacgtgagcgcagctcctcctggtcgctggggccataccctgtcatgcctgaatggatcacggctgattctgtttggtggctgtggggggcagggtctgcttaatgacgtcttcattttggatcttgatgcacagcatccaacttggcgtgagattcctggccttgcaccccctgtaccacggtcatggcatagctcctgcactgttgatggaaccaagctggtggtttctggtggatgtgcggactctggtgttcttctcagcgatacctacctcctagatgtgacaatggaaagacctgtttggagggagatacctgcatcttggtctccaccttcaaggctggggcactcgctatctgtctatgatggcaggaaaatcctgatgtttggtggccttgctaaaagtggtcctctacgacttagatctagtgatgtgttcactctagatttaagtgaagacaagccttgctggcggtgcataactggcagcaggatgccaggagctggtaatcctgctggggtcggcccaccacctcgcctcgaccatgttgtcgtgagccttcctggtgggagagttctgatatttggtggttctgtggcgggtcttcactctgcttcaaaactttacctcctggatccaacggaagataagccaacctggaggcttctgaatgttccagggcatcctccacggttcgcctggggccacagtacttgtgttgtcggagggacaaaggcaatagttcttggaggacaaactggagaagagtggacgctaactgaaatacacgagctttctctagcaagctcattagtctgaagatgggaaggtcccagcaagctttccagcttccttgaagcaatgtctctggagacagctacctgttcatatgacttgaggcagattttttttccaacagtggtgtgcaagcacaagcacaaaagggttggtgaagtggacaaccagacctgattacttgtgccatgcctgggagtcagctggtctaaaagtaggaataagttacctctgctgctgctgttcgtatgatctgaaatgatggaatagctggcatccataagctaatctcagttcttatcatgtttcaaatgggacactggcattatgtcgctggagcccctgatgcaacaggtaccctgccttctggttgcgcctgccttcggtgacaactgatgctgtggtcttctgttttttgacccatcaactgctgtgaagcttctttgttatgcttttgcgccacttcgtgcttactcaattgctgctttctggagaagctgtaacacagacacacctgctgtatttaattttgcctttcgtatcactttgtgcttacctcagctgttagtgatacctataacattttctttttaatctgattatcaaaggatgaattatgaatatcaacagttccatcttaccgcgacattt

SEQ ID NO: 246 - DNA, 4867 bp, Zea Mays
atgaagctgagtgctgctgttctcttcttctccatcttgttgcagtactgcaccagcagcggccagccagatagccgaggtgctttccattctccagactctgcaccaactagctagcttcttctctgactgacctactacacacttgcccttccagcaggtttcataagcatcgactgcggcatcccggagaactccacgtaccaggacctcacctccaccatactctacgtctccgaccgcggcttcgtcacctccggcgagaaccgcaacatctccgccggctacatcagcccgtccctcgcgcagcgctactacaccgtccgcgccttcgcgtccggcgttcggaactgctacaccctcccctccctggtcgccgggaacaagtacctcgtccgcgccgccttctactacgcggactacgacggcctgagcacgccgcccgtcttcgacctgtacctgggcgcgagcctctggcacgaggtcaggttcagggacgcggccgcgatcaactggatggacgtcgtggccgtggctcccaccgacttcctgcaggtctgcctggtgaacaagggcaccggcaccccgttcatctccggcctggacctcaggccgctgcggagcactctttacccggaggcgaacgctagccagtcccttgtcatggtcaacgccaaccggtgcaacgtgggacccacggacaagtctgtggttcggtgagtgagttttttttttaaagtgaaatctttttactgttaataactgaatgaactgtactcctatactacacaagcccaaccaaagcacatttctctggcccaacaagcaggtacccgctggacccccacgaccggatctggctggcgtacggcgccgtcccggcctggaccgaggcgtccgccacgtccgtcgtccggaactacctcgccgacccctacgacgcgccgtccgccgtcatgcagagcgccgcgacgccatccgacggctcggtgctcagtttctcgtgggacacgtccgacgaccgctccgtggacgccagcagcgccacgtacctcctcgtcctctacttcgccgagctgcagcgcgtgtcggcgagcggcgagctgcggcggcagttcgacatcgccgtcgacggcaccgcgtggaacagggaaccttactctccgccgtacctcttcgccgactccttctccggcacggtgcaggggcaggcgaggcatagcgtctcgcttactgcgacgaggaacgcgacgctcccgcctcttctcaacgccatggaggtgtacttggtgaggccggtggatgaagctgcaaccgaccctggagatggtatgagtttaattaactatgtacatcaactctttttttttgtgagttttctgtagttactaaccgtatcggtgttaggaggtttccttgcaatttgtaaagcatgagaagtggtaaaactaattgtttcgcattcgttttctttaacaaacacatacgtatcattgcattaatatagaagaagagagctagagttacaacacacacatatcactgcatttgtgttagttatatcatgttttagatgtatttctatcttggtaacaggctaacagcttgtgtatctatgtacctacttttcttgttttttcggtcgtaccagctaaagccatgatcgcaatccaagaagcttatgttgtgagcaaaaactggatgggtgatccatgtgctccaaaggcttttgcatgggaaggactggactgtactactgatcctccaactggtactccaagaataacagcattgtatgtttcagacatatttgaagggctaaagaaataataatgaaaaaagaatcgttatagcattgtaaataagtttcaatttgaactctcaagctggatacagcaagtgaagctaactgttctgcgtttctcattgttttttggcagaaacttgtcttcaagtgggttgacaggtcccatcactacctattttggagatctgaaagcactccaatacctgtaggatttcttttcccaacaatatcttacttttgacattgaaatgtgatctggcctttttttgttttggtactacttgcaagttccagattaactctatctcgttcatttcctcccctctgcttgtttacttgtatgtttacctattttctctcttgtatatatgtatagtgatttctgcactgtctactatagtagaactgattaacaagatgcatcttgcagtaaatttgttgaatttcatgtgaaatatatgttctctttcaaatgtctcattgttctacctttcttaggctgtgtccaacatatcgtacatttattttacactttagatgaaactattcgcaaaatagagtttaaataggaaatgagataggagagctgccagagatagccctccaccgtcctctgaaaactacatttttgaaagaaaactcatgatgcgaaatatgcgcctttggataggacacgaagcctgtttgttatgactgctttagccttttatttcctgaactcggacatgaaattaagctgacaaatagtaccactgaaacattcgagctatttcttacaagaactgttacatataccagggacttgtcacacaataacttgtctggctccattccagattgtcttggacagcttccattcctagtgttcctgtaagtctcactaaatatctgctcgagttttggaatcttcgtagaacaaacttctcatacgcccatcaattttctctgtagggatctctccagcaatgacctccgtggaccagttccttacactcttcttcaaaaatcccacaatgggactctatcgctaaggtatgttttatactggcggcatgctagttaccaaactgagcaaccctgtttcaaatcaaattgttttattcaaatagttcataaaacatacctggaggatgcggttatactgcttcaaattccgtgcattttatacgtacgcttccaggcttagtaacaacccaaatttgtctgggaacggatcgggtccaaagaagttgaatggggccgcacttctctccgcgataatcatcccaacagttgccgccactgccttgtctgttaccttcattgctctgctgctccgagcactcaaggaacaaggtaatgcagcaacatggaggggactcatatttttttttagaagctgttgcatttctttccttttaatagtgccttttttttcatgcatatgatgcagctagaagacgggctgttgatccaactccgagagatgagacggcgttgcttgagaaccgagaattctcttacagagaactgaagcacatcacgaagaactttagcctggagattggcagaggtgggtttggagctgtcttccttgggtacctggggaacggaaacccggtagctgtgaaaatccggtcggagtcgtcttcgcaagggggtaaagagtttctggctgaggtaattgggaatgatcttaaacaagtagatgtgccacacgtctcgtagccctgatgaacagtagttaatttgaagtactttaatcagtagctattgttaatatatctctcttttgtccccggaacaacatgtttactgagctatatatatgctgcagtgcaggctcaacatctgacgagggtacaccacaagaacctggtatccttgattggctactgtaaggacaaagaccatttcgcccttgtctacgagtacatgcctgaagggaacctgcaggatcatctgagactgagaggttgtctcatcctggcccactcgaatataaaaccaactggctgtgttctggatcaaatactgactgtgtttcttttctttttcttttattttcgcttgggtgtccaatttcttctgatgtgcctagacacttgcactcacagaccactcacttggcagcaacgccttcagatcgcccttgatgccgctcaaggtacacggatgaatgaactgccccgtttctgatgatgcctttatacctgtacactattatatatacaggaagaaaagggaaagagagagaaaaaaaagtcagaacattgttcactctactgcaggtctggagtacctgcatgtggcatgcaaaccagcgctgatccacagagacgtgaagagcaggaacatcctcctgaccacgggccttggggctaagatcgccgactttggtctgaccaaggctttcagcgactcggagacacacatcaccactgaaccagctggaacaatgggctacttggatccagagtacgtctcaggtcttgctgcatgcgcagcttctctcctagctagtatcatatatcatgcatatatatatacaatccagcttcgagagagtaaaaaaactgtccttttttttatcacaggtattaccgcagctaccgggccagcgagaagagcgacgtgtacagcttcggcgtcgtgctcctggagctggtgacaggccagtccccggtcgtcccggtggacgacagcgtgagcgtccacgtcggcgagtgggtgcagcagagcctcgaccggggcggcggcgtcgagagcgtcgtggatccgagcatgggacggtgcgagcgcggcgactacgacgtcaactccgtctggaaagtcgccgacctcgcgctgcgctgccggcgggaggcctccagggagcggcctacgatgacggacgtggtcgcgcagatcagggagagcgtggagctcgaggcggcccgccggagctcggcgtcgggtgctgctgctgctggtggtggtgggggtctgaggagttgtgccggcgagagggacgcgtttgaggtggtggaaggaagcgttggggagacggcgggggccgcgcctggtccggcgatgatctga

SEQ ID NO: 247 - DNA, 3683 bp, Zea Mays
atgagcgacgtgtccgtccgcttcgtggccctggccctggccgccatctcgctcgccgccgccgccgccgccgcgcacgactacggcgatgcgctgcgcaagagcctgctctacttcgaggcgcagcggtcggggcggctgccgtacaaccagcgggtgcggtggcggggccactcggggctgacggacgggctggagcaaggggtggacctggtgggcgggtactacgacgccggagaccacgtgaagttcggcctgcccatggcgttcacggtgacgctgctgtcctggggcgtcctggagtacggcggcggcgtggccggcgcgggggagctggcgcacgcgctgcaggccatcaagtggggcaccgactacttcgtgaaggcgcacacggcgcccgccgagctgtgggcgcaggtcggggacggcgactcggaccactactgctggcagcggcccgaggacatgaccacgtcgcgccgcgcgtacaaggtggacgcggagcacccgggctccgaggtcgccgccgagaccgccgccgccatggccgccgcgtccgccgtgttccgccgcgccggggacgcgcactacgcgcacctgctgctccaccacgcgcagcagctgttcgaattcgccgacacccaccgcggccgctacgacgaaagcgtcgacgtggtcaagagctactacccgtcctccagcggctaccaggacgagctgctgtgggcggcgctctggctgcaccgggccaccggccgccgcgactacctccgctacgccctcgacaacgccgaggcgttcggcggcaccggctgggccgtctccgagttcagctgggacatcaagtacgccggcctccaggtcctcgcatcccaggtacgtacgcacgtcccgatacaccttgaaattaatgtgaataatcttcatatagtatatgaaattaattaattgataacgtacagcgttatcctttttatggtgtgatctgaaccaaccaagtgtagtaggtggttaacattcccttttggatggcccacgcttgatggggagagatgttttaactggaagcctgcatctgcaatgcaagcagcagctcctccaagatagcatagcatcaagggcaagcctgtttggtgcaaccttcccttttgcttaagtctatcttgcaagcatatccctgcccacccattgcttttgcttgtgtttgaatccggtggtggatgcacagcatctccacatccaacaacttcaccttgtggaggaatgcatattgtgcagtacacactcatatgtggactcaaataaaccctaaagcgatatacacaagcggatttcagccatttattttcatttacgaggaaagatttgcgtgtgctaatttgacacatccacatcttcttcgacagaaaccaaccatgcaggcatcaaaagcctatatacacacatggacaaaataaaatctagctcattaagcagaggatgatcaccgctcataaccatggggatcgtatgagacctagctcgtcaattgtttatgatgaccaatccgatcacatatcttccctctaccggttcccccgtcctttgccaactattcctgtcatttccccccccccctctcatgtgctcttggtggcaagcatgcaatattccccaacaaaagaaacagactgttttcctaacactggggatttgtttatgaagcgtagtagagtagactgatgacattgtttgggggaggtcttgtagaaatggactgcgttcctaatcctgacaccaagcattgaccaacgaccacacctcccttccaatgcttaggatgcaagacagacgtctcttaccacgcaaaacatttctttatgcatccacaagcctgcctgcctgcccgcccgtccactgtctcatcatgcctggactgtgatgttctgaagcgagcaaatcatcgaccaactctgaagattctagccgtcttcctggtggtgcacctggacagaggagtcagcgtcgttttgatagtttgttagtgaaagcttaacacataattaaatggtctgggactgggagggaggatcttgcacgtgaagacagcacaggagtcaatcttaaggtagaagaaccatggaacatccgtccatcaacacatgggccattcaactaacagtagttacatgtttgggaaaagaaaaagttgtagtggttggttttggttgttcacagccagagccctgacaaactgaacccggaatggaggatcatgtggctttgatcctgttttttttttcaagtatagttttacctttcggttaacttattattgtataggaaacctacacagtcagttttggacgacactgaaatttggaccataacaagacaagggatgtgtcaagtgtcatatatagcgcccgtggctgctccaatggggaattctgcattcaacagcttcaagtctcacgccctgaagtcaacagttgtatagtgtttggccacatgtttgacaagcaggggatgatagtaatggaatatgacaatctggtttgacgtatttcagtctgaacaatgacactgcagattaaaaagaacatgaaaataatttagaacaaacattgtgctaatgtctcttaataaatcaagatgataaggtccaagtttctgggacatgatgctgtgttcttggggggggggggggggggaggagcgtttttttttttctattctcaacagctgctgatttcgctgtgtttgcagctgctggtggaggccaaggaggagcggctgcggctgagcgcggaggaggtggcggtggtggagcagctgcggtccaacgcggagtactacgtgtgctcgtgcatgaaccggaaccccggcggcgcgaagcacaacgccggacgcaccccggcggggctgctcttcatccggccatggaacaacctgcagtacgtctccggcgccgccttcctcctcaccgtctactcggacgtcctcgcctcgctgggccagcccctacgctgcggctccggcgacgacggtggcgaacccgccgccggcgacgcgggcgacgtgctggctttcgccaagtcccaggccgactacatcctgggcacgaacccgatgcgcaccagctacctggtcggatacggcgcggcgtacccgcggcgggtgcaccaccgcgcggcgtcgagcgcgtcgtaccggcacgaccgggacttcatcggctgcctgcaggggttcgactcgtggtacagcgcgcggcaggagaacccgcacgacctcgtcggcgccgtcgtcggcgggcccaacggcgaggacgtcttcaacgaccaccgcggcgcgtacatgcagactgaggcctgcacgtacaacacggcgcccatggtcggggtcttctccaggctcatgcagctggaggggcagtcgccacgcccggcgccggcgccggcggaggatctttgataggagaggtcgttttccttgaaaggttcccagcgacaagtggtggtgcgaaataaacttttcaaaaaggattaaaaaaagtgatattgatcgtttaggctggatgtatacatgattctttttgttgattcctagatactaccatatttgtttcatgtctttgcacataacaaaagaatcgaaaagaaggatgtaaatttcaaaaatgaactcgatctgttatttggctc

SEQ ID NO: 248 - DNA, 7278 bp, Zea Mays
tctccccccacccaccccgacccttcctcctcccctcggcctctccggcgggcgggcaattcggccatggatcccccacgcggaggtcagcacccctcctcccttccctccttccacggtttccctatccccgtacttctccgcgccgcggtcgccgcgcgcgcggctcgatccgcgcgaccggtggttcgccccacgggtctccgcgtgcggccacggccgattggccgctgcggagcgggattctccgttcgagtcccgccgtcgaggttccatgtctctctcctctctctctctctctctcgcgcgcgcgctggtcgcagcggcggcgggccatccttcgtgccccgcgcggcgcacgaggccgccgccgaatcccagatttatcgtgcatgcgcggcgcctggcggttcccgcgcttcggattgctggtcgggatagtccggtcgccgacgcgtggagaggacgggctcgggcgcggcgcgcgcgcgggggcggggatgccgccgccgccggcaacgttagattcgcgtgcatgcggcggtggctactcggtactcgcattgcggccggggggattcggcgcctttacgtcgctgtccggggatgtacgtgtccgcatctgccgccccgtttggtggcacccggtggtggtagcgaagtatctctttttgggacggaagaaaggcctgggtcagcctcagctgctgggggcggcggctgctgctgctgctgcggttcgtggacttggatgcccattgtgtgattcccatcgcgttgaccgggccgtgtgggatatttattcggatgcaccgctttgttcttggttgtgtggccgctttaggttggtggagggtgttgtgtgttgatttcgtttgttatacagatttacagagggtttacgattcttagcattgttgccgccattgttgctgtctataggtagacgctacaagtaggaggctcctaagaccaacttcaccgggctccgttaattgctatctatccgtttttttccgcgtccaatagcactgtttatgtgtccaacagacatcgtatccaggcatggaaaatgcaagcagattcatccgctccgtatgttggcgttgtctctctactccctgcagttcaaccaccaccttcattcgatcccccgtgactgtagcgtgcctctgcgaggcccctcgatgacgtgcgcctgcaggccggcgaggatccttttgaggttaccggaggtgatggatgaggagggaaggaggtcgtcgaggccggcgccgagcctgcgaatgccgccatggatggcggtgttggcagaagttaaggactgggggaagggaatgttggcgtcagtggcggacccaggaactgatgacagcctaggcgagaatacggtgtgatccccacgcctgtgctcgtgccacgtgctgcttgcttccgtgcactatgctcgcgccttgccctccattgcagccggcgagccagcccaggccaccgcctgcggtgcctgggtggtgagtccgcccctggttggcgtcgtaattgggggtaggggaagaagggtggtcggaggaggacgggtccgagtcctttcccttgttgcgcatgcgtcagtggcggtggtgagggctcctcggacgggcaccgacgcttggccacggagctccacctggtggcgcgcaaagcaaccgtcgctcgaaggggagagcgacacgggccgttatcaggatgctgctgacaaggggaggaggacaaaccaactgtttccacccacggacgggcgtattttacggatgcggacgatgaactgctggagttggtccaataccagctaataatgcatgtggaacacattcatagccccataaaacttgtctcgtatgtggtgccagaatttgagttatgtagaagtgccatgcaagtctattataaatggtcagttacataaggcctatatatactaggaatttgtaactagttattgcattttgcaccgagtgctcacttacttttctatttatggaatatatgtgcatgttttccttttttattgctccctcttttgtgaaacataatacttgtgcgggagggatctacaaatactatgatgtagtattaaatcgagggaacaatgcttcttttggaagggggtagagcacaaggcaaaagtgtgtatgagatgtacctaacactattagtcaaatgcatgcagtaaattcatgctagtaagagactgatgctgattgttcatcattgctgactcaggaaaaatgagatggagatgtctgtactgacatgcaggacacattgacctctttctagtgtagtttcagccatagttatcaaggaggcaaagcgagataaggcgactgcttaccatttggacgcttgtgtgctaaggcgtaaacgatggtgacaccatactagtatggcagctgaaggtttgtgggggagaagggagaatggcatgcaaaaaagaagggtggggagggggtgggtgggtgatgacaccaggtcaagtaaccctaacccatagaggggcaaactagcagcagacgtctgttcattgctgctggagggaggcggctgccgccactgccgtgcgggcttgatgcgacaatccctttgtgctggagtgcagatcggaggctgtgaaccctgcttctgcagtgcaaactggaggtgtaccctgctactgtgtcaaccagaggcagccgctgcagctcgtgatgcgggataagggaggatgattcctcctgagcggtatcctgcagacctcccactctctctctcaaacacttttatctgtcttgtgctctatttctctcacgccacgtctctgtttgtcattcaccagagtctcttgctgttttatcctttattctcctgcttttatctgccgatgacacatcaagtggtgcccgtcacaagtaatttcctgccatttggatgccaaattgacgattttcggaggctacattctatcactccctagactgctccgacgcttaagtgatccttaataacaatggtttttgctaagatgtgctatcttataaaaaccattgtggcctgaaactgacatactcatgcatggtatacttgtaattgtgaatgtgtattggcaaacaaaagaagcttgattacacatgattctgttccaacactatttattgtctgtttattagtttctaggattatgctggaacagctaccatttaatccttgcaaccactatatctttttcttggatgctttatgagatctaataaattcaaggtttctattctgggcttcaacttttttgattttttattatgagttgactacaaagttccttccaaacatgcttctgctatatttttaagcatatttgtgatgcatctaagattttaatgctgcaaaaattcgaattctattttgtatatattaaatgggtggtattggtaatatgttgtgttatttattactccaggaacagtgattgatcctactaaatgtcgattgatgagtgtggatgaaaagcgagaacttgttcgtgatttatcaaagagcccagaaagcgctcctgacaggctccagtcatggacacggcgggaaattgtagagattctttgttctgatcttggaagggagaggaaatatactggtttatccaagcagagaatgctagattatctcttcagggtggtgtctcgaaaatcatctggtccagtggaacatgtacatgagaaagagaaagggaaagataaagagtcaattcttgagcccaatacaactaaccatcagtcccctgccaaacgaccgagaaagagtgacaatccatcacgattaccgattatcacaaacaactcagcagcatctgatgtaactgggccaactaataatctacgcttctgccaaaatttagcttgcagggctattctcagggacaatttttgcagacgctgttcatgctgcatttgttttagttacgatgataacaaggacccaagcctctggttgtcgtgtagttcagaccaacacttacaaaaggatacctgtggtttctcatgccatcttgaatgtgctctaaaggatgaaagaacgggtattctgcagagtggacaaggcaagaaacttgatggtggctattattgcattcgctgttggaaacagaatgatttgcttgggtactgttctgtagcatctttttgttatacagtgtctatgcaacctgatttttttgttcctgtgctcccaatcttatcgcctcctattttagtctgagcttcagtatatcatgcactgatagtcgtaatcaattgagaaatattagtttggtaatagtgagttttagctttgacatttttcatcataacttatcttccaaatactatattttatggaccttacctggtgaaaaagattgaatcttattatatatcactttttttagcttttctgttctgttcttagggtttagtccttgtagtactgtcatcatttaatcaagagaaaaagagtgatcacagttagagaaacaaattttagatatttcaactttgtacttctagaatcaacctgtcatgctttaactttatgcaacacactattgctgtggatactctatgcatccagtttccttctggagtaagatttgtttgtcgggacaggcagctttatgctgggagtactttaggttgcagactataaaaacaggtccttgactttatttaattatctattttttatatcttcttgagggatcttactgctctagtttcaatgtatggaatggattagtttgtcgtttgaaatttgagcatttgaggtgataaggtaggatgtacatgtaaatatgaacatagcatgtagaattgaatgttagaacaaaattatctgttaggttagtcattttatttgaattacctcacaagagggaaaacgaagcatatcccttttgaggtttctgattgacactgtacatgtagtgctctattctattgattgtatttcttggaatggatgaattgttaatcagcagtaccatttggcattgttaacctgctgagctagcatgtgactattaaatttcctttctcatttattaggtgctggaagaaacagctggtgatagcaaaagatgctcgacgattggatgtattgtgtcatcggatttatctcagtcataggatccttgtctccacagagaagtacttggtattgcatgatattgttgatacggcattgaagaaactggaggctgaggtcggtcctttatctggagctccaaatatgggtcgtggaattgtcagtcgacttactgttggtgccgaagttcagaaactttgtgctcaagcagtagatgctgtggaatcattgttctcgggtgtatctcctgctagttcaaaaattcagcgtacgtggtgtacactttatgtttggttttgacatatacaaatggaattgactaattgatccacatttccattttcagggccatgcatgatgcgaccaaactttgtaaagtttgaagctataacccaaacatccgtcatggtatttttggatttggttgattgtcctatgcttgcccaagaggcaacttcttttaatatctggcaccgagtggctgttactgaatcgtacccatcaaatccgactggcataatacttgcgccattgaaaaaattacttgtcacttggctcgcaccggctacaagctatatctttaaggttgtcgcgttcaagaactcaattgagttgggttcatgggaaattagaatgaagacaagctggcaaaaggatgatccaaggggttcaatgccaggtggtaccggactaggacaaaatagtgagagcccaaaggcaaacagtgatggccagtctgatccttcctcagagggtgtggactcaaacaataatactgcagtttatgctgatctaaacaagtctcctgaaagtgattttgagtactgtgaaaatcctgagatccttgattcaaataaagcttctcatcaccccagtgaacgtattaatgacttgcaaaatatacagatggctgcagatggggtaacagaagtcacagagctggaagaagcacctgggctctcagcctcagccttggatgaggaacccaatgcttgtgttcaaacagtgcttctcagggattcaaacccactagaacacaatcagagaactgtggttcctagatcacatgatacatctaatatactggctggacatgagttggtgattgttggacctcgatattctggttctgtgcctcccactgcaccaagaagtgtggaaaacagcaaagacaatggtggaagggcctccaaacccaaaccttgtgacatagttgttcaaaatggctcttcaaagcctgaaagggaaccaggcaattcgtcaaacaaaagagcaacggataaaatggacgactttggccacaaggatagtttctctgaagtgtcctatgaatactgtgtaagggtggtcaggtggctggagtgtgagggctatattgagacaaacttcaggatgaagtttcttacatggtttagcttacgtgccaccctgcaagagagaaagatagttagcgtatatgtggatactcttatcgaggaccctgtcagtctctctggccagctcgtcgacagcttctcggagaggatatatagcaaaaagcggccttccatgccttctggtttctgcatggatctgtggcattaaggaactgcagggtcttaccgttcgctttgtagggagcatattcggcccattcttttgttgcagatcgttgcattgattcttcattggaaatttagctgaagtatttgacttgcacatcttcattgaaactttccttggtgatgacagtaggttatgttatcgtcgggcaacttctttttcccttctgttttttttttcttcatttgctccataataggttacagtgctcccatgttaatcttagagcatcaatgtgctgcattgttcagtcagcttagtgccgtcatgaattttgtggcgtgtagcttgtctgaagaagaggatggttgccaggctggatcaggaatgcgcctgtgggacgaagcaggcttcgtgtggacgctgacgaatccaagctaaccatgtcttgtcggtaaaatggttgtgctgtatcttcggggggatttgcattttcttgctgactctttctgggaatgggaggaatgatgtttaaggtgcagaacgtctgccttaatttaatgttatgttgactcatgctcctttatctgctgcatttgttggttc

SEQ ID NO: 249 - DNA, 6790 bp, Zea Mays
tctccccccacccaccccgacccttcctcctcccctcggcctctccggcgggcgggcaattcggccatggatcccccacgcggaggtcagcacccctcctcccttccctccttccacggtttccctatccccgtacttctccgcgccgcggtcgccgcgcgcgcggctcgatccgcgcgaccggtggttcgccccacgggtctccgcgtgcggccacggccgattggccgctgcggagcgggattctccgttcgagtcccgccgtcgaggttccatgtctctctcctctctctctctctctctcgcgcgcgcgctggtcgcagcggcggcgggccatccttcgtgccccgcgcggcgcacgaggccgccgccgaatcccagatttatcgtgcatgcgcggcgcctggcggttcccgcgcttcggattgctggtcgggatagtccggtcgccgacgcgtggagaggacgggctcgggcgcggcgcgcgcgcgggggcggggatgccgccgccgccggcaacgttagattcgcgtgcatgcggcggtggctactcggtactcgcattgcggccggggggattcggcgcctttacgtcgctgtccggggatgtacgtgtccgcatctgccgccccgtttggtggcacccggtggtggtagcgaagtatctctttttgggacggaagaaaggcctgggtcagcctcagctgctgggggcggcggctgctgctgctgctgcggttcgtggacttggatgcccattgtgtgattcccatcgcgttgaccgggccgtgtgggatatttattcggatgcaccgctttgttcttggttgtgtggccgctttaggttggtggagggtgttgtgtgttgatttcgtttgttatacagatttacagagggtttacgattcttagcattgttgccgccattgttgctgtctataggtagacgctacaagtaggaggctcctaagaccaacttcaccgggctccgttaattgctatctatccgtttttttccgcgtccaatagcactgtttatgtgtccaacagacatcgtatccaggcatggaaaatgcaagcagattcatccgctccgtatgttggcgttgtctctctactccctgcagttcaaccaccaccttcattcgatcccccgtgactgtagcgtgcctctgcgaggcccctcgatgacgtgcgcctgcaggccggcgaggatccttttgaggttaccggaggtgatggatgaggagggaaggaggtcgtcgaggccggcgccgagcctgcgaatgccgccatggatggcggtgttggcagaagttaaggactgggggaagggaatgttggcgtcagtggcggacccaggaactgatgacagcctaggcgagaatacggtgtgatccccacgcctgtgctcgtgccacgtgctgcttgcttccgtgcactatgctcgcgccttgccctccattgcagccggcgagccagcccaggccaccgcctgcggtgcctgggtggtgagtccgcccctggttggcgtcgtaattgggggtaggggaagaagggtggtcggaggaggacgggtccgagtcctttcccttgttgcgcatgcgtcagtggcggtggtgagggctcctcggacgggcaccgacgcttggccacggagctccacctggtggcgcgcaaagcaaccgtcgctcgaaggggagagcgacacgggccgttatcaggatgctgctgacaaggggaggaggacaaaccaactgtttccacccacggacgggcgtattttacggatgcggacgatgaactgctggagttggtccaataccagctaataatgcatgtggaacacattcatagccccataaaacttgtctcgtatgtggtgccagaatttgagttatgtagaagtgccatgcaagtctattataaatggtcagttacataaggcctatatatactaggaatttgtaactagttattgcattttgcaccgagtgctcacttacttttctatttatggaatatatgtgcatgttttccttttttattgctccctcttttgtgaaacataatacttgtgcgggagggatctacaaatactatgatgtagtattaaatcgagggaacaatgcttcttttggaagggggtagagcacaaggcaaaagtgtgtatgagatgtacctaacactattagtcaaatgcatgcagtaaattcatgctagtaagagactgatgctgattgttcatcattgctgactcaggaaaaatgagatggagatgtctgtactgacatgcaggacacattgacctctttctagtgtagtttcagccatagttatcaaggaggcaaagcgagataaggcgactgcttaccatttggacgcttgtgtgctaaggcgtaaacgatggtgacaccatactagtatggcagctgaaggtttgtgggggagaagggagaatggcatgcaaaaaagaagggtggggagggggtgggtgggtgatgacaccaggtcaagtaaccctaacccatagaggggcaaactagcagcagacgtctgttcattgctgctggagggaggcggctgccgccactgccgtgcgggcttgatgcgacaatccctttgtgctggagtgcagatcggaggctgtgaaccctgcttctgcagtgcaaactggaggtgtaccctgctactgtgtcaaccagaggcagccgctgcagctcgtgatgcgggataagggaggatgattcctcctgagcggtatcctgcagacctcccactctctctctcaaacacttttatctgtcttgtgctctatttctctcacgccacgtctctgtttgtcattcaccagagtctcttgctgttttatcctttattctcctgcttttatctgccgatgacacatcaagtggtgcccgtcacaagtaatttcctgccatttggatgccaaattgacgattttcggaggctacattctatcactccctagactgctccgacgcttaagtgatccttaataacaatggtttttgctaagatgtgctatcttataaaaaccattgtggcctgaaactgacatactcatgcatggtatacttgtaattgtgaatgtgtattggcaaacaaaagaagcttgattacacatgattctgttccaacactatttattgtctgtttattagtttctaggattatgctggaacagctaccatttaatccttgcaaccactatatctttttcttggatgctttatgagatctaataaattcaaggtttctattctgggcttcaacttttttgattttttattatgagttgactacaaagttccttccaaacatgcttctgctatatttttaagcatatttgtgatgcatctaagattttaatgctgcaaaaattcgaattctattttgtatatattaaatgggtggtattggtaatatgttgtgttatttattactccaggaacagtgattgatcctactaaatgtcgattgatgagtgtggatgaaaagcgagaacttgttcgtgatttatcaaagagcccagaaagcgctcctgacaggctccagtcatggacacggcgggaaattgtagagattctttgttctgatcttggaagggagaggaaatatactggtttatccaagcagagaatgctagattatctcttcagggtggtgtctcgaaaatcatctggtccagtggaacatgtacatgagaaagagaaagggaaagataaagagtcaattcttgagcccaatacaactaaccatcagtcccctgccaaacgaccgagaaagagtgacaatccatcacgattaccgattatcacaaacaactcagcagcatctgatgtaactgggccaactaataatctacgcttctgccaaaatttagcttgcagggctattctcagggacaatttttgcagacgctgttcatgctgcatttgttttagttacgatgataacaaggacccaagcctctggttgtcgtgtagttcagaccaacacttacaaaaggatacctgtggtttctcatgccatcttgaatgtgctctaaaggatgaaagaacgggtattctgcagagtggacaaggcaagaaacttgatggtggctattattgcattcgctgttggaaacagaatgatttgcttgggtactgttctgtagcatctttttgttatacagtgtctatgcaacctgatttttttgttcctgtgctcccaatcttatcgcctcctattttagtctgagcttcagtatatcatgcactgatagtcgtaatcaattgagaaatattagtttggtaatagtgagttttagctttgacatttttcatcataacttatcttccaaatactatattttatggaccttacctggtgaaaaagattgaatcttattatatatcactttttttagcttttctgttctgttcttagggtttagtccttgtagtactgtcatcatttaatcaagagaaaaagagtgatcacagttagagaaacaaattttagatatttcaactttgtacttctagaatcaacctgtcatgctttaactttatgcaacacactattgctgtggatactctatgcatccagtttccttctggagtaagatttgtttgtcgggacaggcagctttatgctgggagtactttaggttgcagactataaaaacaggtccttgactttatttaattatctattttttatatcttcttgagggatcttactgctctagtttcaatgtatggaatggattagtttgtcgtttgaaatttgagcatttgaggtgataaggtaggatgtacatgtaaatatgaacatagcatgtagaattgaatgttagaacaaaattatctgttaggttagtcattttatttgaattacctcacaagagggaaaacgaagcatatcccttttgaggtttctgattgacactgtacatgtagtgctctattctattgattgtatttcttggaatggatgaattgttaatcagcagtaccatttggcattgttaacctgctgagctagcatgtgactattaaatttcctttctcatttattaggtgctggaagaaacagctggtgatagcaaaagatgctcgacgattggatgtattgtgtcatcggatttatctcagtcataggatccttgtctccacagagaagtacttggtattgcatgatattgttgatacggcattgaagaaactggaggctgaggtcggtcctttatctggagctccaaatatgggtcgtggaattgtcagtcgacttactgttggtgccgaagttcagaaactttgtgctcaagcagtagatgctgtggaatcattgttctcgggtgtatctcctgctagttcaaaaattcagcgtacgtggtgtacactttatgtttggttttgacatatacaaatggaattgactaattgatccacatttccattttcagggccatgcatgatgcgaccaaactttgtaaagtttgaagctataacccaaacatccgtcatggtatttttggatttggttgattgtcctatgcttgcccaagaggcaacttcttttaatatctggcaccgagtggctgttactgaatcgtacccatcaaatccgactggcataatacttgcgccattgaaaaaattacttgtcacttggctcgcaccggctacaagctatatctttaaggttgtcgcgttcaagaactcaattgagttgggttcatgggaaattagaatgaagacaagctggcaaaaggatgatccaaggggttcaatgccaggtggtaccggactaggacaaaatagtgagagcccaaaggcaaacagtgatggccagtctgatccttcctcagagggtgtggactcaaacaataatactgcagtttatgctgatctaaacaagtctcctgaaagtgattttgagtactgtgaaaatcctgagatccttgattcaaataaagcttctcatcaccccagtgaacgtattaatgacttgcaaaatatacagatggctgcagatggggtaacagaagtcacagagctggaagaagcacctgggctctcagcctcagccttggatgaggaacccaatgcttgtgttcaaacagtgcttctcagggattcaaacccactagaacacaatcagagaactgtggttcctagatcacatgatacatctaatatactggctggacatgagttggtgattgttggacctcgatattctggttctgtgcctcccactgcaccaagaagtgtggaaaacagcaaagacaatggtggaagggcctccaaacccaaaccttgtgacatagttgttcaaaatggctcttcaaagcctgaaagggaaccaggcaattcgtcaaacaaaagagcaacggataaaatggacgactttggccacaaggatagtttctctgaagtgtcctatgaatactgtgtaagggtggtcaggtggctggagtgtgagggctatattgagacaaacttcaggatgaagtttcttacatggtttagcttacgtgccaccctgcaagagagaaagatagttagcgtatatgtggatactcttatcgaggaccctgtcagtctctctggccagctcgtcgacagcttctcggagaggatatatagcaaaaagcggccttccatgccttctggtttctgcatggatctgtggcattaaggaactgcagggtcttaccgttcgctttgtagggagcatattcggcccattcttttgttgcagatcgttgcattga

SEQ ID NO: 250 - DNA, 2847 bp, Zea Mays
gtcaagagcagccgtcagccccgtcaccagcaagactcgccccccactactcttcctcctccaacctcccctcctgtctctccctccctccctggcagcgactactccccaacccgcacgcacgccgtgagcataaagccgtcgcgcgcccacacgcccgttttcatttccatcggttccctttccaaactcaacggccgcggcagggagcaggcacagtcacctccctgacccgttgagccgtcaattttatcccgccccgcgatttcctacagctgccgatcgaggaggaggcgcattgcccgcattcttctccgcttccaccgagagggcctcgcctgatcggcgccgccttggcccccatgacgtgtgtgcgcgccgaggacgccgtctcgcccgccgccgccgacgacgtggcggctgccctggtgtgagtgggattcccggccccttcgtctgatgcgttttctttgtctcgttactctcgctgaatctttcacggactgtgcgaatgccatgtttctgcttgggttccagttccaggggcggcttgatccagaaggtggctgccggcggcgggcggagaccggcaggctcggcgcgctcgctgcagcgctcagcacatctggccaccggggacggcaacgctccggcgccggcggtggaggccagttgctcctggtccggggtaagctctcggttgactttcattcgtccaattagcgcagcgttcaccctgcacaaaatccacaattttttctgtctggattcggtacaacattgttcagagaaagttaaaaaattatttttttcggtggacaaaagcgagattttaacggcaagcgtagcaaagttggtgtcctttcgctggtgctgtgccgtggtgcggagggcactgtcggcctcagctacaccgcgtgctcccctgcgctgcgcacttcatgtgggggacctggatgaactgtccctaacctccctggtccctacttcccattgagtaccacagtctgtttagtcaaccaacaatcttgttgcttattggttcttcgatttggtttctttccagcgaattaatgtcgcagcaattgtttttttttgtttactcgtttgtaggatgggataggtaagagcaacggtggtgggaagagagatgatagacacaggatgcggcagtacaggtcgcagctcgaacaggaggtggatgatcctcttaagccctgtgatttgtttctcgctatgctgtaattgtgtcacctgatgcgattcaataaccctgtcaaaatcgtgcaggtcaagaaattgcagaggcagcttgaagaagaggttgatctgcacgtggcgttggcggatgctgttacacaaaatgttgcgcctatactgaagtcttctatgaagcttccacacaaggtgtgggcttgataactctgatgattaaatttcacatgtttctttgtgcttattcgatatcatgttctagacggctaaggcatccagtgaccacgctctttcaacctttcgttctgcaggcacaggagctactgattaacatcgcctccttggagattaccgtttcaaaccttgaaaagaagctaaatgatctgtactaccagctttgtcacgaaaggaacgaaaggttacttgctgaaaataatcagggatgcttgccatctacatcctccgatgagcaccagtcattgtcaacttgcacgtgtacgtgggaagaggtaagtaccctctgagcaaacatttcagcaacttctttctgatttgggattcactgacagtttcttgattaccaatcttagcacatatcatcgttgagagatttgaagtttgggggatctgaatcaatgagatcaatgagacaggacttattccccgagcttgaagatgaccaggatatgggagaagatcctgagggtcaacagatagtttctttaaacaggctgctagaaaagcaccgagattcttctttgaatagacttcttgaaaagcatcgagatgaagaggtccctttcatgcttaccttacctctatagttttaagaaccaactttggaacatattagagtatcaagaatttatttatctttcagcagatgcaagaatctggctccatggaaaatgaaggcaatgaaaatgagcagcctgacacgttatcctttgaacagtctattctaaagataactagcataaaaggagggaatctttggagcaacccaaatgagctctctgaggagatggttcgctgcatgagaaacattttcctacgcttgtctgaatccttgaagatatcgccgaagacatcttctgattgttcatcttcctccgtggagcgtctatcaggctccacgttagcatctttctcagattcatccataatgccctcaatgctacggagtccttcagttgattctaatcacaatgacgagacgatgaaggaagtcaggaactttgatccgtataaagttaatggaaaggaaacccgaagagatatcggaaactatcgttcagcagctgaagtatcttggatgtctgttggaaaggatcaactagaatatgcatctgaagctttaaagaagttcaggtttgctgctacagccttggctaaacctatgagtcctcatagatatatcacatgtctacaaactgtacaaaccttagtgcatatatacaaaaattttagcatatgatgtatacttttaaattttgttcagccttgttaatgttctaaaagaatatgcagacaatcgaaccagtctagggatttggattgggggaacaaatggatgctctattcttgttcgcttgcagtaaagcaatcagtttcaaaattggtttgcgtata

SEQ ID NO: 251 - DNA, 5039 bp, Zea Mays
gtcaagagcagccgtcagccccgtcaccagcaagactcgccccccactactcttcctcctccaacctcccctcctgtctctccctccctccctggcagcgactactccccaacccgcacgcacgccgtgagcataaagccgtcgcgcgcccacacgcccgttttcatttccatcggttccctttccaaactcaacggccgcggcagggagcaggcacagtcacctccctgacccgttgagccgtcaattttatcccgccccgcgatttcctacagctgccgatcgaggaggaggcgcattgcccgcattcttctccgcttccaccgagagggcctcgcctgatcggcgccgccttggcccccatgacgtgtgtgcgcgccgaggacgccgtctcgcccgccgccgccgacgacgtggcggctgccctggtgtgagtgggattcccggccccttcgtctgatgcgttttctttgtctcgttactctcgctgaatctttcacggactgtgcgaatgccatgtttctgcttgggttccagttccaggggcggcttgatccagaaggtggctgccggcggcgggcggagaccggcaggctcggcgcgctcgctgcagcgctcagcacatctggccaccggggacggcaacgctccggcgccggcggtggaggccagttgctcctggtccggggtaagctctcggttgactttcattcgtccaattagcgcagcgttcaccctgcacaaaatccacaattttttctgtctggattcggtacaacattgttcagagaaagttaaaaaattatttttttcggtggacaaaagcgagattttaacggcaagcgtagcaaagttggtgtcctttcgctggtgctgtgccgtggtgcggagggcactgtcggcctcagctacaccgcgtgctcccctgcgctgcgcacttcatgtgggggacctggatgaactgtccctaacctccctggtccctacttcccattgagtaccacagtctgtttagtcaaccaacaatcttgttgcttattggttcttcgatttggtttctttccagcgaattaatgtcgcagcaattgtttttttttgtttactcgtttgtaggatgggataggtaagagcaacggtggtgggaagagagatgatagacacaggatgcggcagtacaggtcgcagctcgaacaggaggtggatgatcctcttaagccctgtgatttgtttctcgctatgctgtaattgtgtcacctgatgcgattcaataaccctgtcaaaatcgtgcaggtcaagaaattgcagaggcagcttgaagaagaggttgatctgcacgtggcgttggcggatgctgttacacaaaatgttgcgcctatactgaagtcttctatgaagcttccacacaaggtgtgggcttgataactctgatgattaaatttcacatgtttctttgtgcttattcgatatcatgttctagacggctaaggcatccagtgaccacgctctttcaacctttcgttctgcaggcacaggagctactgattaacatcgcctccttggagattaccgtttcaaaccttgaaaagaagctaaatgatctgtactaccagctttgtcacgaaaggaacgaaaggttacttgctgaaaataatcagggatgcttgccatctacatcctccgatgagcaccagtcattgtcaacttgcacgtgtacgtgggaagaggtaagtaccctctgagcaaacatttcagcaacttctttctgatttgggattcactgacagtttcttgattaccaatcttagcacatatcatcgttgagagatttgaagtttgggggatctgaatcaatgagatcaatgagacaggacttattccccgagcttgaagatgaccaggatatgggagaagatcctgagggtcaacagatagtttctttaaacaggctgctagaaaagcaccgagattcttctttgaatagacttcttgaaaagcatcgagatgaagaggtccctttcatgcttaccttacctctatagttttaagaaccaactttggaacatattagagtatcaagaatttatttatctttcagcagatgcaagaatctggctccatggaaaatgaaggcaatgaaaatgagcagcctgacacgttatcctttgaacagtctattctaaagataactagcataaaaggagggaatctttggagcaacccaaatgagctctctgaggagatggttcgctgcatgagaaacattttcctacgcttgtctgaatccttgaagatatcgccgaagacatcttctgattgttcatcttcctccgtggagcgtctatcaggctccacgttagcatctttctcagattcatccataatgccctcaatgctacggagtccttcagttgattctaatcacaatgacgagacgatgaaggaagtcaggaactttgatccgtataaagttaatggaaaggaaacccgaagagatatcggaaactatcgttcagcagctgaagtatcttggatgtctgttggaaaggatcaactagaatatgcatctgaagctttaaagaagttcaggtttgctgctacagccttggctaaacctatgagtcctcatagatatatcacatgtctacaaactgtacaaaccttagtgcatatatacaaaaattttagcatatgatgtatacttttaaattttgttcagccttgttaatgttctaaaagaatatgcagacaatcgaaccagtctagggatttggattgggggaacaaatggatgctctattcttgttcgcttgcagtaaagcaatcagtttcaaaattggtttgcgtatatttttctctcattttgagccgttaaagaattcctgtcagcatgaaatttgctaggatgtgaatgcattggggaacagcttttctatctccattttggcacaccttgtggtttatgttacatttctttaaccctggatcttaaaaactgccgataaaagttaacatatcttagacggtgtttggatgaggagccactcttggaattgagagattttgatccaaatcctccctactcaaataagaacttaagaattagtaaatcccctacatctcacaacaaatatattcttactccacttttttgaaatttgttcggtgtggatgctgctgccctacattctagacaatgtgtactgtgttcgctcgttattttgaatgtaggtgatatactgatatttgagcacacatttttttgttcaatgtttcgcagatttctagtggaacaattgtcaaaggttaatcctagctgtatggatcgcgatcagcggctagccttttggattaacttatacaatgctttgataatgcatgtaagtatgacctggttacttaagatgctggcatcgcagacaaggacaatgattaaatttctgtctataattggaaacaggagctcacttcaattcatcgcatctgccctcaatttctttcatcaagtgtcatgcgctcaccaattgtttaccgttgcatttttttatcggaatctatcaggcgtatttggcatacggagtacctcgaaatgacatcaagcttttttctctgatgcaaaaggtttgagcagcacatcttctgctgttagtctaagatcgcacatcagaccgttaattttgtgaaatgtgcaggcttgttacacagttggcggccagtccttcagcgcagcagaaatagagtttgtgattctaaagatgaagactccagttcatcggccccaacttgtataacttgtttctccgtcctagtcttcaccttcgggttttataatttattgtcttgtctcttattttgcctttgctttctttcagtctttgatgttgactctgaataagttcaagattactgaggatcacaagaagtactcaatcgatgaattcgaaccccttcttttgttcggacttagctgtggaatgttctcttctcctgctgtaagtagtacgccggctaatcttagccctgtcaagctgtgcatgtgcttcagcaaattcgtcacttaataagttgctggagaaactagagccatgctgtcacccattctgctattcttgtcctacctaatcttagtcttgttaaggcctgtcatccttcagttctatttgtctgatttaccgttgcttgagctggacggttataagattgctaaaacctaagctattgctgggtcaccctgttgtcgcacaggtacgcatattctccgctgcaaatgttaggcaggagctccaggaatctctgagagactatattcaggcgactgtcggtacaaatggcaaagggaagctgctgatcccgaagctagtgcagagctacgccaagggagctgtcgaggactctctgctcgcagactggatctgccaccaccttgcacctgatcaagccacggtcatccgggactcttcctcgcagtggaagcagcggctactcggagctcgaagcttcaccgttctcgccttcgactccaagttccggtacctcttcttgccagacagctgtggctcccagagccagaagccagaggcaaagcaatcttacaaacttcctgagccgtgttcagaatcagaatagataataagagctcagtttggtatatttggaccatcatacattcttttgcatagcgggccatgtgattggcagttgtatatgatgtaaattttgaggaagcttgaattgctgtgtttgcaaaaccggatcctctccacggagttggtggcaatttgggggtcgtattggttttcttttgtattcacttgtcttccatactgaagataacattcttttgttgtttttgttttatctgcataccttttcctttttttcccctctccttttctgtaaacctgtatggtcaatttgatctgtaacttctgcacaaataaaggtggtgagcagtctttacttaggtttttctgcacaactgattagggacgaagccagtcggtggggcgagcggggctcgacccccctacctcctatactaa

SEQ ID NO: 252 - DNA, 4070 bp, Zea Mays
aacctccctggtccctacttcccattgagtaccacagtctgtttagtcaaccaacaatcttgttgcttattggttcttcgatttggtttctttccagcgaattaatgtcgcagcaattgtttttttttgtttactcgtttgtaggatgggataggtaagagcaacggtggtgggaagagagatgatagacacaggatgcggcagtacaggtcgcagctcgaacaggaggtggatgatcctcttaagccctgtgatttgtttctcgctatgctgtaattgtgtcacctgatgcgattcaataaccctgtcaaaatcgtgcaggtcaagaaattgcagaggcagcttgaagaagaggttgatctgcacgtggcgttggcggatgctgttacacaaaatgttgcgcctatactgaagtcttctatgaagcttccacacaaggtgtgggcttgataactctgatgattaaatttcacatgtttctttgtgcttattcgatatcatgttctagacggctaaggcatccagtgaccacgctctttcaacctttcgttctgcaggcacaggagctactgattaacatcgcctccttggagattaccgtttcaaaccttgaaaagaagctaaatgatctgtactaccagctttgtcacgaaaggaacgaaaggttacttgctgaaaataatcagggatgcttgccatctacatcctccgatgagcaccagtcattgtcaacttgcacgtgtacgtgggaagaggtaagtaccctctgagcaaacatttcagcaacttctttctgatttgggattcactgacagtttcttgattaccaatcttagcacatatcatcgttgagagatttgaagtttgggggatctgaatcaatgagatcaatgagacaggacttattccccgagcttgaagatgaccaggatatgggagaagatcctgagggtcaacagatagtttctttaaacaggctgctagaaaagcaccgagattcttctttgaatagacttcttgaaaagcatcgagatgaagaggtccctttcatgcttaccttacctctatagttttaagaaccaactttggaacatattagagtatcaagaatttatttatctttcagcagatgcaagaatctggctccatggaaaatgaaggcaatgaaaatgagcagcctgacacgttatcctttgaacagtctattctaaagataactagcataaaaggagggaatctttggagcaacccaaatgagctctctgaggagatggttcgctgcatgagaaacattttcctacgcttgtctgaatccttgaagatatcgccgaagacatcttctgattgttcatcttcctccgtggagcgtctatcaggctccacgttagcatctttctcagattcatccataatgccctcaatgctacggagtccttcagttgattctaatcacaatgacgagacgatgaaggaagtcaggaactttgatccgtataaagttaatggaaaggaaacccgaagagatatcggaaactatcgttcagcagctgaagtatcttggatgtctgttggaaaggatcaactagaatatgcatctgaagctttaaagaagttcaggtttgctgctacagccttggctaaacctatgagtcctcatagatatatcacatgtctacaaactgtacaaaccttagtgcatatatacaaaaattttagcatatgatgtatacttttaaattttgttcagccttgttaatgttctaaaagaatatgcagacaatcgaaccagtctagggatttggattgggggaacaaatggatgctctattcttgttcgcttgcagtaaagcaatcagtttcaaaattggtttgcgtatatttttctctcattttgagccgttaaagaattcctgtcagcatgaaatttgctaggatgtgaatgcattggggaacagcttttctatctccattttggcacaccttgtggtttatgttacatttctttaaccctggatcttaaaaactgccgataaaagttaacatatcttagacggtgtttggatgaggagccactcttggaattgagagattttgatccaaatcctccctactcaaataagaacttaagaattagtaaatcccctacatctcacaacaaatatattcttactccacttttttgaaatttgttcggtgtggatgctgctgccctacattctagacaatgtgtactgtgttcgctcgttattttgaatgtaggtgatatactgatatttgagcacacatttttttgttcaatgtttcgcagatttctagtggaacaattgtcaaaggttaatcctagctgtatggatcgcgatcagcggctagccttttggattaacttatacaatgctttgataatgcatgtaagtatgacctggttacttaagatgctggcatcgcagacaaggacaatgattaaatttctgtctataattggaaacaggagctcacttcaattcatcgcatctgccctcaatttctttcatcaagtgtcatgcgctcaccaattgtttaccgttgcatttttttatcggaatctatcaggcgtatttggcatacggagtacctcgaaatgacatcaagcttttttctctgatgcaaaaggtttgagcagcacatcttctgctgttagtctaagatcgcacatcagaccgttaattttgtgaaatgtgcaggcttgttacacagttggcggccagtccttcagcgcagcagaaatagagtttgtgattctaaagatgaagactccagttcatcggccccaacttgtataacttgtttctccgtcctagtcttcaccttcgggttttataatttattgtcttgtctcttattttgcctttgctttctttcagtctttgatgttgactctgaataagttcaagattactgaggatcacaagaagtactcaatcgatgaattcgaaccccttcttttgttcggacttagctgtggaatgttctcttctcctgctgtaagtagtacgccggctaatcttagccctgtcaagctgtgcatgtgcttcagcaaattcgtcacttaataagttgctggagaaactagagccatgctgtcacccattctgctattcttgtcctacctaatcttagtcttgttaaggcctgtcatccttcagttctatttgtctgatttaccgttgcttgagctggacggttataagattgctaaaacctaagctattgctgggtcaccctgttgtcgcacaggtacgcatattctccgctgcaaatgttaggcaggagctccaggaatctctgagagactatattcaggcgactgtcggtacaaatggcaaagggaagctgctgatcccgaagctagtgcagagctacgccaagggagctgtcgaggactctctgctcgcagactggatctgccaccaccttgcacctgatcaagccacggtcatccgggactcttcctcgcagtggaagcagcggctactcggagctcgaagcttcaccgttctcgccttcgactccaagttccggtacctcttcttgccagacagctgtggctcccagagccagaagccagaggcaaagcaatcttacaaacttcctgagccgtgttcagaatcagaatagataataagagctcagtttggtatatttggaccatcatacattcttttgcatagcgggccatgtgattggcagttgtatatgatgtaaattttgaggaagcttgaattgctgtgtttgcaaaaccggatcctctccacggagttggtggcaatttgggggtcgtattggttttcttttgtattcacttgtcttccatactgaagataacattcttttgttgtttttgttttatctgcataccttttcctttttttcccctctccttttctgtaaacctgtatggtcaatttgatctgtaacttctgcacaaataaaggtggtgagcagtctttacttaggtttttctgcacaactgattagggacgaagccagtcggtggggcgagcggggctcgacccccctacctcctatactaa

SEQ ID NO: 253 - DNA, 15688 bp, Zea Mays
  misc_feature (3582)..(3681): n is a, c, g, or t
  misc_feature (4640)..(4739): n is a, c, g, or t
atggaggtggcgcgcaccttccatccccgcggcgcgcaccgcttcctgtgggcttcctgtgggcagcagatccatagacctcaaggtaatccgcccgcggccgccactccccacactcgcttcctgtgggctacgcgggtgaaggagcgcgcgcgtgcgtacgtgcgggtggttggacttggatctgctgctgggtggggcgcgggatggcgtcgttcgttgtgtccggcgtgaggctcggggtcgtgcggcccggcggctcggcgtgatctggcggggagcggaggagtgcgatggacttgccgtcggtgctcttcaggaggaaggacgccttctctcgtactgctcgctcgcttccccctccccctctattcttagtcggctggtcgctggctctcctcgcttttctccctctgcgcttgtgtggcgtttgtgctggcctggatcctgagtggttctgcttctcatacgcgcacacatatttttttcttattcctattctgcatttcgaccagtggaagccatcgaccgcggttcctaaactcggatcctgcattttgttgcggcgatatgcgttagtgttatcaattgctgcagcgatacttccaatttctatgccgataggtttcctcgttttcttcttattttgtttcctcgtcgttgcagcctgcaaattggtggtttcttggttcttatcagtggagctggctttggaatttgcatgcaccgttctgagctgcgttgctgctcctggaaaggtgctggtgcctgtaggtggcagtgatgacttgctttcctccgcagagcctatcgtggacactcaacctgaagaactatagattcaattgtccccttctgtgcctccatggtacaaatgtccaaatgtctgatgaaatcaagtttgggtttcagcctttgcttatatcaggcattgtgcaaagcctcgtgaattgttggttagggcacagagtgcagagtgcagaccaaacaaatcaggccttctaatgcctcggccttgtctggcgccgcagctacctcctctacggcccgccgggcacaggcaagtccacgttcgcggcggccacgaccaggttcctgggctacgacatctattttgaataatctgggcaagtccacgtttgctagcaggtgaatatttagatcctattgcagtcattcgggcaaaggcaaagcgcaaggcaaataaacttagttgtttctcatccaaataccagtggagacaaagatgtgacttcagataacaaatctcagcatggatcttcagaattacctcctagagctgaattgattggtaacaaacaaatccatactacgattaagacagcaaactgggcgcgcctcacgcggccaatgcccccgtctcgtctcccctcaaagtctgccatgtgaccccgacttgccttcccctctgcgcatccgcgctacctcggtctgtggtatgctttgttattgttacaagtttctgtagggaaaaaagtgctaagctcctgaaaaaactactgtaccatagcctatttgtgcagtctttaaactcgtagcgaaatattagtggccagtagcatcactgcagtactggtctgtggttatgtgttgcttattctttggttcaactgtgtgcaggaccaacttcttttgcacctcttatttatgcagcgatttatgttgttgaaaacagtaattggcagtaccatgtcctcgtgatcatagctgatgggcaggtaacatgttcataatagcatcaaaatacttcactggaattatgaacatatttgacctgataaaaagttgtaggtgactgccgcgaatataattgatggaagattaagtccacaggaacaagcaactatacaagcaattgttgatgctaggtaaaattcagttcatcattccttagaactttggtcttgtggtattactgaagcctatttggttatcagctactatcctctttcaatagtaatggttggagtgggtgatggaccatgggatgcgatgcagcattttgatgactgtattccttagaaatttttatcattggttcctgatagacagtttgccaaaaacatggttctttccttcataaactaaatttacaggttcaagagacatttctagcccaattttgcaatatttttgttgatttgatatggtagattcactattcttttcagcagggagtgtaataggcggctttagctcaacatgaactggagcaggtaggcttgatggaaacatccctttgaaatttgatatttcggaagcagtatggaaatttgttaatggctcgaaagtagcatcaagccgagatatcggcataggaggtctgatggaagtaaatggctggttgcttttagtggaatcaaaaccatgcatcgaaggttgaattttggtggaaaattgcctacttgcaagaggaacatcagtaaagttgggaagatagacatgtgctgaattgtacgttcctggtctaggataatacactttctgaagtggaaaaaatgtttgaatagagtgaggtagctggtttatattgtttaaaggcatctgcccagaagcaggaacatttataaaggaatgcccatgtctatctagcatcagttcttcgtgtgtctctggatgtgttatcttgatagttctcttatgttcatcaccgcttctaggatactgctgagataattcttgcacatttctcatgtttctaactctgaacatgtccagagtgcatcaccttgtctatttagtataaagggacaatgcagttcttaccctttctttctgttactgaaagtcgcctagagggggggggtggataggcgaaacctgaaaattaaaactttatcccccaactagatcctttgattagtggttagaacaagatgaacaattatcggagtgtaaaaactaagttcttgctagtaaagagtatagctttcaaataatgcggaagtgataaatcaatacaactaataattctatgataacaaagcaagaaagcttagatgaaaaagagcactaactcaagttcttttcttgcggagtgttgcttcacttaaatgagattttaacttgaagcaaacaccaaatgatatgagcaaagaatagtgcaagagaacttaagggaaaacaaacaaatcacaagcaaaagcacaatgaacacgggtgatttgttttaccgaggttcggccctcgaaggcctagtccccgttgaggagtccacttgaggacgggtctttttcaaccctttccctctctcccgatcacacaaggatcggcgagctcttcttcttctcaaggatcactctcgatcccacaaggaccaccacaatctttggtgtctcttgctagcttttacaagcctccaacactttggaggaagttcgaatgggagtcaaaaactccacgcgcaaatgaacacaaagattgtagcacacactatctctcaatgaatctcacaaggcgctagggctaaactcaattgagtagctctcaattgcttgctctctcttttgtggcacttgtgttggttgtagtggactaaatcttgtgtataggatggatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccggaaattcacaaaaaagaactctcctgtcagaaataatttacggtatttccgggacatcggattagtacagttataagatgaacatttggcactgtagagcatataatttagagcaaactagttagttccaattatttgtgttgggcaattcaaccaccaaaatcattttaggaaaaggtttgagcctatttccctttcaatctccccctttttggtgattgatgcccaacacaaaccaaagcaaataaaataagtgcagaaattgaactagtttgcataaggtaagtgcaaaggttactttgaaaattagaccaaatttacatttaatgttttagaccatgcttgcaccaattgttttgtttttgcaaactctttttggaaattcttttcaaaaatgttttgcaaaatagtcaaaggataaataaataagattttgagaagcattttcaagatttgaaattttctccccctgtttcaaatgcttttcctttgactaaacaaaactccccctcaatgaaatcctcctcttagtgttcaagagggttttaagatatcaattttgaaaatactactttctcccccttttgaacgtaataagataccaatttgaaatttaccaattgaaaatcattagttttaccaatttgaaattaggaggtggtggtgcggtcattttgctttgggcctaatactttctccccctttggcatgaatcgccaaaaacggatactcagagtgaaatgtaggccctcaaataactactttctcctctttggcaaataaaacatgagtgaagattataccaaatacggagagacggcgggataccggcaaagagtggataataccaatggagttgagtggaagcgatgtctttgcccctattctccatttccctttcaatctaagacttaatacatgagatgctaacgaattcaagcttgattttttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggcaaaacaaaaacactagacgactgagaatcgttttcatctaagacttaatacatgagatgctcatgaaaacatattagacagaaccttggcacacaatgaagataagaaatatgcaaatgaaccaaaggaaagagacatgattaaaaggatatatcaattaagcttaaacaattatatacaatatagattgctccccctaaatatgtgcatagagaagaaaacaaatttttggtctaaaaatgccaagtgcacataattaggttaatgagaccatgtctatatcataaagagtgtaaagtgcattgtgtcatagtataagtgtgatgctaatgacattttatgcacttatgaaagcatgttataaatatctcaaacatttacctttaaggatttcaaggagacttaaggaccatccaccttttggaacaaaaggcagcttatcctcgttacaaggttaagctttaagctccttgacaataaaattacttcacccagtttaaacaaagatgtaaaaatgaatgtttgagaagttaaactaggtatgaagcagggttaatgcatgaacatgctttttcttccttttatacaagatatgcaaggaatgtaggaaaatttaggtacatgtatgaatgagattgagaagttttacccttttctacctttacatagtgatgctctcttcattgtgctttgtccttagtcttattgaatctgcctaagacctgtactcaagacaatgtatggaaatattttgcacaatagagagttctacaactagtgatccttttctaagtcattgtttagcatttatcaaaatggatcacaaattgcataaatgtatcatgaattctccttttaacttagtgcatatcaagatagatgtcagttaatattacaattgaaatcaaattcaaatttcataaggcactaaggagcataagtgataattgaagttgttcaatgatcaaccaatatgagatcaagaaaacaacaaaggcattaaattttcaatcaagcttaaaaataggagaatccaataagcatgctactttagaaatgaaagcaacaatccttgataaaagcgacattattttaacaagctggattgatgtgtagtagcatacaatatgagaaacattattctcatgcaagagactatatgaaatttctaagacaaagcaatagtctcaacataatcaaaatataataatggactccccctacagatatgcatcaaataatttaaagaattgatttcgatgcattcacttttaagaacataaagggagaagcattatatattttgatcaaggctcataaatttagcaataaacaacttgagcctggtaatctcataatgaaaaaggatttagaatgcttacaaccacatcattgattgttgtgaagaccttattgtccaggtagatgttgttgtccttgatgttctttctttttcatttgagtgtcctccctttatatttgtctcttttaccttccaaacttattgaaaatactcaagagacatgttaatagcgcaagggagtctatggtgaaggatgattactttagataattagcatacaagattcatcatccacaagtcacacagacatgaagtaaaatccctagcattagtgcacatcataggaaaagaggaatatgcactatttaaccatttgatcaatcataggaatttacttcttcatattgagtttattaatcattattttaaaaaacaagtcaatatgagagcatttatagcaaaggtatgaaatagattttaatggacaaatgcattaaagagattgaggttgaatgcacgtttagttgaaatgagtccaataaagaatctatttctcacaagggtagaatagattaaatagacattgagatgggaactaaattcaactaggatgatgagttcccatacctttgcttttacctctcttcctttgggtgaggagcaacccatgaggcttgtggcattaaacttgcacttactctcttgtagtttttcataagtaagctcaagagagatgttaagaacaacacaagcactagtttccctttttgtaatcattttgataaggaatgaaaagtggattattaaagcatggaaactttataatatgaactagattattccaataagcatgctaagttttaactcataaaacaagcatggttaaattcttgatactatgggaataaatctaatccataacatggagagcgataaatgaagaagaatcatctccaatttaagcaataaaacatacatacataaattattggaatgattttacttgtcatgatggattacgcatttccatagagaaatttatctctacaagtgagactacttaaattacttagataaaaacattagtctcacttttctagctatagagagaatttttccttttataagtgtcctaagtatttgaatttcttacatgacaccttattcttttaagaacatgaaatatctatggcaataataggataattaaagtaaaatatgccatgggaacttgcaacaatttaaagcatgtagattgtcataatatagaattgataaatacacaatctaccatatgagaggaatttcttcaaagaatgatgacataattttaaaacatgcttaagtgctttctatttctatgtgactacacaagacacatgacaatttaagataattgtacttaagaatataaatgttaccatcctttgattttcctccatgttgtaggctttgttattccgcacatgatgattctttatttcctacaacattaatatcttcccgagatgatatgagttttgaatacaataaattgaagtaaccttgggtcaatcttgaatatgtagatcatttgaagattgatagcttgagttgataagaattgaattaactccctcatgcaccccaaaggttcataccatctccttctcctacaaagcttgtcaagcacattttggtacccatcgcttgatgggtctgttaaggttagtgaacaaagatctaggaacccaagtgtcctttgtgctagcgcttggtaaacttgttacctttctagcacaagttgcaattttgggttgcctagttacatgaaaattaattgacaagctaggagtggaattgttaccaatgggacaatccttgcattgatgtccctttcttcggcatgtgtagcataggcgtttttcaagttttgaagttttcttctttccttgcttgttgcctgctacatggttagtaaaaattttcttttctaaccctatgcctttttgttttaaatggggacaagatctaagcaagtgtcccttcttagagcatttaaaacaaagtctatcatccttgttaataatcaagccattaatatagggacatgacctaatcaagtgccccatttcaaagcattcactacacctcttaatgtgaagtgtggcttgatcattaccttggatgttaccttttgtggagacgtggttgaggcttttggaggaggtgttgaatttcttcttttgtttattcctcttggcaatcctcaaatccttgacattttcttcaagggatgtagtgcatgccacggttgttcccgtctcaagcttcttcaccatgtgatcacggttatcttgagaaggttgggcaatgcatttccctttatgttgtgtcaagctcttctttaacctctcattttcttctttgagcttttgatatgaatcatcatttgttcctgcagattctagctccaaagaagatttgcttgtcgacgaacaacaagcattagcacctggttatatagtatcaattttgaatacatgtgcatgagtgaggttgttgggattttaaattttctatcacaacctcatgagcaatgtttaatatgatatgatcatctataagattttcatgacaacatagaaggcatatcatatttattttgaaaagctagatttttcaacttttagcttttctacttggtctttgagcaaggtattcctatttactaattgagcgatacaatgtgaagcgttatcttgctcaattgaaatagtttcatacctttggaccaaatcaacatgagagcactttagctcctcatgttctttagtcaactcgtcaaggtgttgcatctttatggagagaatatcttctagcctttgacgagcttcgctttgctctctcgctctttctagaagtttgagcatgaccgccttatcttcttggcttaggcgagcgtagagatgcacaaagcttctttcttcctcctcatcctcatttgtgcttccgctatcattttcattagccacacaacacatgtgggaatcgaaatgggaagacaaaccttttggagaggtggattcatcgtttggtctccatcgttcattttctccttcttccttgcaagggttagtatcacaaaaactaaaggaagtagaggcatcaaatgaactattatgtttggactcatcaaacttgattttaattctagtccaaatatcatgcgcatcgggaatggattcgtcatagtttgatatgaaggcatgataatcttctttgctaagagaattgtttaagatgtcaaaagctaggtagtttaagcgataacatctttgatcttcctcggaattaatttttccattaaagctagagggaaaaatactcttgtcaataatttgttctaattgaggatgtatggttctaaaggcatttatcacactagtacaccatgaatcataattagaacaatcatcacataatatctcaagagttacctccttccgagttgggttctcctgggtcttcttgttcttttgggatcttctacgagccatcacttcgagttgttagactcaagatgaagtgcctagctccgataccaattgaaagtcgcctagaggggggggggtggataggcgaaacctgaaaattaaaactttatcccccaactagatcctttgattagtggttagaacaagatgaacaattatcggagtgtaaaaactaagttcttgctagtaaagagtatagctttcaaataatgcggaagtgataaatcaatacaactaataattctatgataacaaagcaagaaagcttagatgaaaaagagcactaactcaagttcttttcttgcggagtgttgcttcacttaaatgagattttaacttgaagcaaacaccaaatgatatgagcaaagaatagtgcaagagaacttaagggaaaacaaacaaatcacaagcaaaagcacaatgaacacgggtgatttgttttaccgaggttcggccctcgaaggcctagtccccgttgaggagtccacttgaggacgggtctttttcaaccctttccctctctcccgatcacacaaggatcggcgagctcttcttcttctcaaggatcactctcgatcccacaaggaccaccacaatctttggtgtctcttgctagcttttacaagcctccaacactttggaggaagttcgaatgggagtcaaaaactccacgcgcaaatgaacacaaagattgtagcacacactatctctcaatgaatctcacaaggcgctagggctaaactcaattgagtagctctcaattgcttgctctctcttttgtggcacttgtgttggttgtagtggactaaatcttgtgtataggatggatcaatgaatatatgtggttgggagggcttgagtatgtcaactagatgacttggaatgttgcttggactcccacactttgaagtggccggttggggtggtatttatagccctcaaccacccatatagccgttggggcgcatctgccagaaattgcactggcggacggtccgcggctagggcccggacggtccgcgaccctccaacggtcgattctgacatcttcaacggatacttctgacagatcaacggttagatcaacggctatctgcctcggtgacaccacgcggacggtccgcccttggtcccggacggtccgcgccagctatataattccttttgctcaacttgtcaccttcgggctgaaccaggtcttcacctgcggactgtccgcaaattatagccggacggtccgcgcgttgtagctggacggtccgtggtttattcggactgtccctgatttatagttcctggtcgaagtcaaagcggtgacgcggacgatccgccgcaagggcccggacggtccgcgcgtggtctcggacggtgcttgctcttccatcggacgatccgcagtagagacacatgtttttgcattggttctgtccgaggtttatttaggtgtcgcggacggtctgccgcaaagacccggacggtccgcgcttggcctgattttccaaaaagcttctcctgtccggaataatctacggtattccggacagtcgatttagtacagttgtagatgaacctttggcacctgtagagcatataatctagagcaaactagttagtccaattatttgtgttgggcaattcaaccaccaaaatcatttaggaaaaggtttgagcctatttccctttcagttacacaggtgtagcatcttcaaacaagaacgaccaggcgaagacggaacagtgatcttcgcccgtgttatttttctatattgtaggcacacatctttgagttgcctgaagaaaagctatgcctctctttcctttccaacaataacacgggcgaagacggaacagtgatcttccgaggggataagcactatgtgcctagcgttctgtctccattcttgctgggtgcaagaacgtagtttacaataccaagagagtacgtttgtttgcacttaacgacaactgaattaggaacataggcattgggccctaatctttattttgtttgttacgacaggtgtttgtacaacacagtgaaaggtcattccatacctcagatgtaacaagcaagaataaccagtgggagatgtactcagaaacggtcccaaagtatcgtgatactaaagtcaggacaaaggaacccctggagcaatataaccaaaccaaggacgatactgactacttatggtacaccacaaggtatcactcttatctgtcacatcttacagtttcagctccatgtcactctttattctttctcgatcataaaattcacttgattatatttttatttgttaccatcttcagctttcgcttggagtcggatgatttgccctttagaaatgacatccggcctgtgcttcaggtcaaaagtagtgcacacgcaatgatgggatttgctaatgatgctttcgtaggtaacttggaccaactctgtaacaatcttgttcctccaaagacactcgcttgttgcatgaatgcaagtaaaactattgtacaaatcaaaatccctctccatgtaggatgtgcacgcagaaacaagcaggtgaagggtttcatgtttgaaaaaccggttgatctgaaagtaggtgtgaaccatgtcgtattgctgtcatcaactatgggaatgaaggtaaaattttgtcggaattgtggaatgtgtttggaatgtaagatggctgattatactgtcctgtccgatagccaggtgaaaaaattgtggttgtattattgcaatagacaaacacttcatttttgaaaggcagacatatatagtttatatcataaatagaagggtggcccatgctctcagataatgcaataatcctgcccatcagctctaaatttgcatgtttcactatcttctgcaggatagtggtggtgaacttgctgaagtaaagggcggcattcaggagtgcctaatccaaggtctcaacactgggacgttggatttacaagtcaatggctggggccataaagtaaggctgttatctttaactccaaaagtaaagccatttcctcgcaagcacgaatgtcatcgtgtgggacctgatcacctctacgcttctttacaaataggctgcactagaaggtgagtacaaggagatctactcagaaaaggtttgggcaaagttcagtggaaaccggccgagaacgaccgggcagccacttggtataaggtaagttgaaccacgaatacgagcactatagattttgttcagttttggttgcaaccctcaccctcggtgtcactatgttcactgccatgctagagttactttgatgagccagatggagatgatcccgttgtacttgacatgagctcaatgagcaagggaatgatttttgtgaatggcgaaggagtgggtagatactaggtctcataccgaactcttgctggaactccttctcaaggagtgtaagtctgtggagttaaccttattgaggcaggtcgtatactgttcttggccaacaagcttgacaacaaaaggtcttttcatttgccatcgtggcatctgtggagcgggtgtggagcgggtgttcgcggacaaggcggtgccgtcgtggcgggagcagctcacgctgcgggcattcgtcatcaacgcgctgctggccgtcatgttcagcgtcatagtcatgaagctcaaccttaccacggggatcatcccctccctcaatgtctctgttgggctgctcggcttcttcttcgtctgcatgtggactgccgccgccgagaggatgggcttcctccgccagcccttcaccaggcaggagaacactgtcatccagacctgcgttgtctctgcctacgacatctccttcagcggtggctttggcagttatctatttggaatgagtgaaaaaatagctaaacaagcaacaacggtggtatggatttactttttgttcctgcaatgaatatgtctgcaaacatttacatgggaaatgtggagatttgtggaatttcactttaacttatcaacaatactgaaagtcgcctagagggggggtgaatagggcgaaactaaaatttacaaagttaatcacaactacaagacgggttagcgttagaaatataatcgagtcctcgagagagggtgaaaaaacaaatcgcaagcaaatacgaagtgtgacgcgcggatttgttttaccgaggttcgattctcacgaacctactccccgttgaggaggccacaaaggccaggtctttttcaaccccttccctctctcaaacggtcccttggaccgagtgagctttctcttctcaaatcaaccgggaacaaaacttccccgcaaggaccaccacacaattggtgtctcttgccttggttacaaatgagtattgatcacaagaaagaatgagaaagaagaaagcaatccaagcgcaagagctcaaaagaacacaacaaatctctctcgcttaacactaaagcttttgtggaattgggagaggatttgatcacttgggtgtgtcttgtattgaatgcctagctcttgtaagtagttggaaggtggaaaacttggatgtcttgaatgaggggtggttaggggtatttataaccccaaccaccaaactagtcgtttggtggaggctgtctgtcgcatggtgcaccggacagtccgatgcacaccggacagtgtccggtgcgccagccacgtcaccaggccgttgggttccgaccgttggagctctgactgctgggcccgcctggatgtccggtggcacaccagacatgcactgtagagtgtctggtgcgccacttcgcgcgtgcctgacttctgcgcgctctggcgcgcatttaatgcttttgcaggtgaccgttggcgctgaatagtcgttgctccactggctcaccggacagtccagtgtacaccagacatgtccggtgaattatagcggagcgaattcccgaagctggcgagttccagagtcgctcttccctggggcaccggacactgtccggtgaattatagcggagcgcctctggattttcccgaaggtgaggagttcagcgtgaagtcccctggtgcaccggacacgtccggtggtgcaccggatagtccggtgcgccagaccagggtgccttcggttatccctttgctctctttgttgaactcgattcttggtctttttattggctaagtgtgaacctttgacacctgtataacttatacactagagcgaactagttagtccaattatttgtgttgggcaattcaaccaccaaaattaattaggaaaataggtgtaagcctaattccctttcaagtaccacggaggaacaaattttggaaggactggcgcttcttatgtgctgattggatactatgatgaagctcccatggatgaatatggtcacatcgactcagttgaccatgatatttctgttttttatcttaatcatgtatgctcctattgacataagaagcacctaatgtagtccatgaattttcataggtatgtacaaggagcccaaatttgggcatctcagggacttgcacaacgtaatatggtcatatcaaaaagcattcctctgggggcaacattcgtctgagatattgggtcattggtatgaggttgggaacaacttcttcaatcattttggtttctggaaacttatattattatttgacagtgttctccgaccttcaaatgaatcttctttggtgttgtgattatttttctatattgtaggcacacatctttgagttgcctgaagaaaagctatgcctctctttcctttccaataataacacgggcgaagacgaaacagtgatcttccgaggggataagcactatgtggctagccgttctgtctccattatttggggttaccgaggaggtatgattattgccctgcataacatacatgtgttttaaaactgaatacttcaacttgagtcctccttctcattgaatttgccttctcattctattaatttgttgatcatagtcagtcctcttgttctgctgtagtttggactttggcacattgacaaaatttgattgcccatgcatttgcagagtgtgatcgatattatccatgcttgataaatgatgacaatggtgatggccatgatatatggtcaatattgtattga

SEQ ID NO: 254 - DNA, 6052 bp, Zea Mays
atgatgttatcagaccccaaagattgcacgctctgcaagggtagagaaataattattggggagcatgttacaaacatgatgcaaattttctccttaaagttggctaagattgatgtggatggtggccccatagagttgtatggatatatcgctacgcgggatgttctcgagccattgcttaactatattgtcaatgttagcaggaatgatcctatcaccatcgagcaggtgcacacctcatgcttctgtatagtgatttcaaattcagtattattgattttgtagtacaggccaaacttatcacatgcatgcatgtatagaagtagaacagatgggattggatcatacataattttgatgacatacttcaaccacttaataatttcttacaccatcaagctaggagcctaggaaaggttgaatattattgttgtatgaactatgtctttattattcgacgaacaagtactccctctatcccaaattataagtcatttcaactttcttggggagtcaaagcatctaaagtttgattggaattacaaaaatctgttacaacaaatatttaaactatcatgagaatataaatgatgaagaattgaatgatacttattggtatcataaatataattattttaatatacaaatttggtcaaacttaagatgatttgactctccaaaaaaaagttaaaacgacttataatttaggatgtggagggtaccgcctatgagttcctaagttgtttgtctgccatatatgtatttatcttgtgattattttcttacattgtttcttaccagaagagctactgaatatatagtatataatacacttgtagggttccctcatagaaatgactggccctaagcgaggcattgagttgtgtggcgaaattatgcttgaatttgacatgaggattaagaggggcggagaagagaaagacgacccacagctgattgatggtgtagcaatcgtactagacgagatgagcatgcctaggagtacttatgcattcacaaaacggatccacggcgattgtggagcggttgacataacggtatcacgccttgactttgcagttgaggcgacgatacaacttcacgtatctgaagtagagggcagcttcagtttgcgtgcgggctgttttaccagtgggttatgtgaagaaatccagatctttaagggcaccattagtgagccgcgtgccttgaggagatgtgttgttgctgcagtacatgatacttggatggatgtgaagttgaaggttgacgactcagggcattcttatagcagtgatgacaatccggaacattggtgtagcttcaaaacgaccagtcatggatggacctgccaacaggtaaagcttgagtttgcatccatattggtgaaggtgacttggtcatcgacgtgtttcatggaattgttctagagtttaaccaagtctgctgttcttgttcacgcaggcaagtttgtgtctgcatgcacgcgtttcatttcatctcatccatccttggttcgtttcatgcatgttaataaccaagcatgcaggctttgctcattctttttgaaactatcacgtttgctagttgtgttcagtaatagtctgtgttaggttaaggacctaacagccgtgctactgaaactgttttttttaatattctcctcttttttttccatttttcttctgtttcctcccttgtgtagagctgctcatgagcgtcttcctgcggaatctgaaccagaacctggaaatgtttttttacgaactatttcatacgtagcaggcctggccgtacgcgatacgcgtgtcggcgagtggtgcggacccccacaccagacgctttcttcgtgctgcaatctggagttcacatacgcatgcatatatacatacatacatgtattcttggttcaagcaagcatggcaaagataaacttttgaaatacatgtccggtaacaactgaaattattaacatatgcaatctggagttcacatatgcaagttataaacttttgaaatacatgccacaaaagaaacttttgaaatacatggcttcgatctgcggtattcctttttgaaatacaataggtagatatacaggttacagtacactgcaaagtggcagccgacatctgaggtcaactaaagcaggagggagaccgagggcaaaagaattggatccggttcgtgcagacgtgagcgccacatcttggtcaacagaacagctgatgaagatggaacgacaagtagacaagtctatcgtgctgctgcattgctgcttggggacccaaatcggccacaacagagtagctgcaagcctgcaattagtagagactgagataatgcatggaaacaataacactagtgtatattaaattaaatcatgattaaagtatgagatcgaatcgccatctgaaattatgcatatcctgcaacgactcagtagtcacagtaaccaatgggtgggtggagacgaaagcagcccccttttttttccttttgggttcgcgcagaaggtttggactttttacataaaactatcataccaggttggctcatccaaaaacgtggagctctgaatctggccgtgtgaatcagccgagaagctgctaaccagctgtggcaaatgcgccgggaaaagaaaagggtgtggatgtgtgcccacagcagccatgcagtaagttgacccaattttcatttccatttcctacgtacggctgcaactgcaagcaacagataaactgggggctgcctgttgtctcttcttcctccacgcgctcttctgctagtttcattgggcatcgtcgtccagtcagcatcagatccaagcatctgctttgatgctagtttcattcatcaggaagccatgcagcagcagcaacgggtgcatccctcacatgacaacgacaagcacaacaacgatgggtttctcaaacctctcctaggcctcgcgctcgcgctcttgctatccgccttcctcccgcctacgagctcgtgctcggagcaggagaggagcgccctcctccagttcctcgctggactctcgcgggacggcggtctcgcctcgtcgtggcggaatggcacgggctgctgcgcgtgggaaggggtcggttgcggcgcagacggggcagtcaccgatgtctcccttgcttcaaggggccttgaggggcaaatctcggcgtccctgggtgagctcaccgcgctgctgcgcctcaacctgtcccacaacctgctgtccggtggcctgccggcggagctgacgtcgtcaaacagcatccttgtcctcgatgtcagcttcaaccgtctcaacggaggcctgcgcgagctaccttcgtcaacccctccccgtcctctgcaagtactcaacatctcgactaacttgtttacaggaccgtttccatcgaccacatgggaggcgatgaccagtctggttgcactcaatgccagcaacaacagctttaccggacagataccaagccatatctgcagtagctcaccggccttggctgtgattgaagtctgctataaccaactcagtggcctcgttcctcctgggcttggtaactgctccatgctcagagtgctcaaggctggccacaatgccctcagtgggtcactccccgatgaactcttcaatgctacgtcactagagtacctctcttttcccggcaatggtttgcacggaatgcttgatagcgaacacatcatgaagctcagaaatctggcccaccttgatcttggaggcaacaggctaagcggaaacatcccagattccataggccagctcgagaggttagaggaactgcatctgaacaacaacgacatgtctggggagctgccatcaactctaagcaactgcacaaatctcataacgattgacctcaaggtcaacaacttcggcggagagcttcagaaggtcgacttcttcagcctgcccaatctgaaaacattggatcttctgtacaacagcttctccggcacggttcctgaaagcatctactcgtgcagcaagctgaatgcgttgcggctctctaacaacaacttgcatggacagctttccccagcaatagccaatttgaagcatcttgttttcctgtcactagtttccaacagttttacaaatatcacaaatacgcttcagatactcaagaactgtaggaatctcacctccctacttattggaagcaacttcaagggtgaggacatgccagaagatgagacaattgacgggtttcagaatcttcaggttctttccatgtctaactgctcgttgtctgggaaaatacctctttggttatcgaagctcaaaaatttgcaggtgctgcttttgcacacgaatcaactcagtgggacaatacctgcctggatcaaaagcttagagtcactattccatctagacatatcaagtaacaagcttacaggggaaataccaacagccttaatggagatgccaatgctaacgacagaaaagactgcaacccatttggatccaagggtatttgagctacctgtttataaaaacccatcgctccagtaccggataaccagtgctcttccaaaactgctgaaacttggttacaataacttaactggtgcgattccccaagaaattggtcagttgaagtcgctcgctgtactcaatttcagctcgaacaacttatcgggaaaaataccactggaactctgcaacttaacaaatctgcaagtactagacttgtctaacaatcatctcagaggtgcaatcccatcagcattgaacaacctacacttcctctccgcactgaatatttcttacaataacctggaagggcctattcctactggaggccaattcagtacattctcgaataatagctttgaaggtaatccaaagctgtgcggacctatcctccatcacagttgtagctcagcagtcgcaccaacagtctcaacaaagcaacacagtaggaaagccatttttgggattgcatttggttcgttctttggagttgctcttcttctgcttctggtatatctcgctgtctcattcaagtgtaaaaggttgataaagaaaagcaagatcagtgataacgaagatgtagaagcaacttcacacgtgtctgattcagaacagtcattagtgatagtgccaagaggagaagggggagaaaacaagctcaaattcgctgacattgtgaaggccacaaataacttccaccagggaaacatcataggttgtgggggctatggtctggtctacaaggctatattacctgatgggaccaagctggccatcaagaagcttaatggtgaaatgttgaccatggaaagggaattcaaggcagaggttgaagcactctccatggcccagcatgagaatcttgtgccactgtggggttactacatacagggagattcaaggctcctcgtatattcctacatggagaatggcagccttgatgattggcttcacaccatggatgatgatgccagcacatttctcagttggccgatgcggctgaaaattgcgcaaggggcaagccaaggcctttcttatatccatgatgtctgcaagcctcacattgtccaccgtgacataaagtccagtaatatcctacttgacaaagatttcaaggcttacgttgccgattttgggctctcaagattagtccttgcaaacaaaactcatgtcacaactgagctagttggcactctgggctacatcccacctgagtatgggcaaggctgggttgcgacgttgagaggtgatatctacagttttggagtcgttctgcttgagctgctcacaggaaggcggcctgtctcagccttgtttttatcaaaagaacttgtgaagtgggtgcaggagatgaaatcagaagggaagcagattgaggtcctcgatccacatctacgaggcttggggcatgacgagcaaatgctgaaggttcttgaaatagcctgcaagtgtgtcgaccatgacgcgtgcatgaggccaaccatactggaagtagcctcctgccttgacactatagagcccaccctgaggatgcaaaattcagttaggatatag

SEQ ID NO: 255 - DNA, 2713 bp, Zea Mays
gaccattttggggcgcacatataagccaccgccgcctcgcatctcctcctccgccccacgcagctgaggcgttgatcctcaccggcgtcgccatcgtaatcgccttggacagcggcaccagaacctctgcctccgcaggtgagttcgcctccaaacgcatctccttttccgcttctcgatccgttagggttttaaccggaggctgaggttgttctaccagctatatcgatctgcccttgtaaggctgaagcttcagatgtttaacaattggagcaactattcaacagaattatggaaagcaagtcctactgtattagcaatagttttatcatcacctgtagtagaaagacccttgattgtttggtttgcttgcctgctttcaatataatttttattcgatcttgttgccttgtacctgattatttacatgattacttgtcttttttgtgttacagtagctgtttttatttaatcttgttgccatgtacctagttatttacataatcttatgttttctttcgtcacttgcagggtgcttgctggtatcattacaatctggtagttttagtggttgggcttgacttcctactattcagaaacacagtaccgagaagtctttaggtggggtcaaagatggtgtcgctgaagttgcaaaagcgccttgccgcgagctacctcaagtgtgggaaaggcaaggtgtggcttgacccaaatgaagttagtgagatctccatggcaaactcccgtaagtattatccactgcttggttctgcctggttcgtaatatgtttgacttctgctctgatttttgctattcttgtttgggtctgtgttcagctgtgatcttgacatcatatgagctgtggcgatctgtttgtagtgttcttggtccatttttctgctgttgagctttatagccgtcaaaatgggtagcacagttcactttatgggcatggtcaaaggtggatactttatgtagtttgaatatgttggatcaaacattattcttaccgccatggtttttaaagcggtaaggcggtccaaggcgttggaccaccgctacgcctaggcggcgcctaggcgttagaccaccgtccggacgcctaggcgacgccttaagaacagagcttaccgccaccatgttatagtgttatttacctgccaccacccttgaagacactattggctgtagctgctctagttcgttacgcgtgtacccgtgcagtctctaatttgtatatgttaatagttaacctgatgcagttgtagttctcttgaaataacaattccagtttatgattgtttttatgtattgtttatgcatatgtgattgtagattttggctaaggctggtattgcctgtgatcaaattgtgaatagactggaagaggaagcaataccattgcctagcttgacataattgtaacatttaatgctcctattattggtcactgttaatttttcattgattattatctggctgtctcttgctaaatatttgcactgcttagccaactctgattttgtcatgttgtttctcaaatctcaatttatcatactgaccatgatgggatagtactcaagtcttttacattcctgggattttgctgtgctttgccatgagtttatattttacattaacatagtgcattagagttttgaaattgtaggcaagtagagttgtttctatgttattctgctttaacttttaaaggaacataaaggggtctatgtttttgcaatacttacaggccagaatatccggaagttggttaaggatgggtttatcatcaagaagcctcataagatccactctagatcccgtgcaagaagggcacatgacgccaagcaaaagggacgccactcaggatatggtatgctgctgcaactcatttatgtcacagttctgaagggtgagtaagctcgtggtaatccgatgcctgtataggtaagcgtaggggtaccagggaggctaggctacccaccaaggttctgtggatgaggaggatgcgtgtgctgaggcgccttctccgcaagtatcgtgaggccaagaagattgacaagcacatgtatcatgacatgtacatgaaggtcaaaggtaacgccttcaagaacaagagggtgcttatggagagtatccacaagtccaaggctgagaaggccagagagaagacactttctgaccagtttgaggccaagcgcgccaagagcaaggcgagccgtgagaggaagatcgctaggagggaggagaggttggcccaggtatgataatgttatgttgatccataccttgcaattcgtttagaatcttgtttaaatgtatgctttgtcgtatagggtccacgagaaataacaccacctgtctcatccacagctccagctactgggtaagcgccttggagctctttgtttcgtttccttggattttatcatgtttttttgttgatgtgtttctctttgtttggccgatgtcacagggcaccgaagaaagcaaagaagtgaagtattgaaataaagctgtagctttctagtccagtactgcactttcttttataagctctagtcaaattttggagcgcctgaactgttttgctgttatataacttagtgtattgataaattcgactatcacatctggattattctgctggataatgtccgtgtctttgatgtttgtgttaaattcctattctggatgagcacctggccctaa

SEQ ID NO: 256 - DNA, 2655 bp, Zea Mays
gaccattttggggcgcacatataagccaccgccgcctcgcatctcctcctccgccccacgcagctgaggcgttgatcctcaccggcgtcgccatcgtaatcgccttggacagcggcaccagaacctctgcctccgcaggtgagttcgcctccaaacgcatctccttttccgcttctcgatccgttagggttttaaccggaggctgaggttgttctaccagctatatcgatctgcccttgtaaggctgaagcttcagatgtttaacaattggagcaactattcaacagaattatggaaagcaagtcctactgtattagcaatagttttatcatcacctgtagtagaaagacccttgattgtttggtttgcttgcctgctttcaatataatttttattcgatcttgttgccttgtacctgattatttacatgattacttgtcttttttgtgttacagtagctgtttttatttaatcttgttgccatgtacctagttatttacataatcttatgttttctttcgtcacttgcagggtgcttgctggtatcattacaatctggtagttttagtggttgggcttgacttcctactattcagaaacacagtaccgagaagtctttaggtggggtcaaagatggtgtcgctgaagttgcaaaagcgccttgccgcgagctacctcaagtgtgggaaaggcaaggtgtggcttgacccaaatgaagttagtgagatctccatggcaaactcccgtaagtattatccactgcttggttctgcctggttcgtaatatgtttgacttctgctctgatttttgctattcttgtttgggtctgtgttcagctgtgatcttgacatcatatgagctgtggcgatctgtttgtagtgttcttggtccatttttctgctgttgagctttatagccgtcaaaatgggtagcacagttcactttatgggcatggtcaaaggtggatactttatgtagtttgaatatgttggatcaaacattattcttaccgccatggtttttaaagcggtaaggcggtccaaggcgttggaccaccgctacgcctaggcggcgcctaggcgttagaccaccgtccggacgcctaggcgacgccttaagaacagagcttaccgccaccatgttatagtgttatttacctgccaccacccttgaagacactattggctgtagctgctctagttcgttacgcgtgtacccgtgcagtctctaatttgtatatgttaatagttaacctgatgcagttgtagttctcttgaaataacaattccagtttatgattgtttttatgtattgtttatgcatatgtgattgtagattttggctaaggctggtattgcctgtgatcaaattgtgaatagactggaagaggaagcaataccattgcctagcttgacataattgtaacatttaatgctcctattattggtcactgttaatttttcattgattattatctggctgtctcttgctaaatatttgcactgcttagccaactctgattttgtcatgttgtttctcaaatctcaatttatcatactgaccatgatgggatagtactcaagtcttttacattcctgggattttgctgtgctttgccatgagtttatattttacattaacatagtgcattagagttttgaaattgtaggcaagtagagttgtttctatgttattctgctttaacttttaaaggaacataaaggggtctatgtttttgcaatacttacaggccagaatatccggaagttggttaaggatgggtttatcatcaagaagcctcataagatccactctagatcccgtgcaagaagggcacatgacgccaagcaaaagggacgccactcaggatatggtatgctgctgcaactcatttatgtcacagttctgaagggtgagtaagctcgtggtaatccgatgcctgtataggtaagcgtaggggtaccagggaggctaggctacccaccaaggttctgtggatgaggaggatgcgtgtgctgaggcgccttctccgcaagtatcgtgaggccaagaagattgacaagcacatgtatcatgacatgtacatgaaggtcaaaggtaacgccttcaagaacaagagggtgcttatggagagtatccacaagtccaaggctgagaaggccagagagaagacactttctgaccagtttgaggccaagcgcgccaagagcaaggcgagccgtgagaggaagatcgctaggagggaggagaggttggcccaggtatgataatgttatgttgatccataccttgcaattcgtttagaatcttgtttaaatgtatgctttgtcgtatagggtccacgagaaataacaccacctgtctcatccacagctccagctactgggtaagcgccttggagctctttgtttcgtttccttggattttatcatgtttttttgttgatgtgtttctctttgtttggccgatgtcacagggcaccgaagaaagcaaagaagtgaagtattgaaataaagctgtagctttctagtccagtactgcactttcttttataagctctagtcaaattttggagcgcctgaactgttttgctgttatataacttagtgtattgataaattcgactatcacatctggattattctgctggataa

SEQ ID NO: 257 - DNA, 2235 bp, Zea Mays
gaccattttggggcgcacatataagccaccgccgcctcgcatctcctcctccgccccacgcagctgaggcgttgatcctcaccggcgtcgccatcgtaatcgccttggacagcggcaccagaacctctgcctccgcaggtgagttcgcctccaaacgcatctccttttccgcttctcgatccgttagggttttaaccggaggctgaggttgttctaccagctatatcgatctgcccttgtaaggctgaagcttcagatgtttaacaattggagcaactattcaacagaattatggaaagcaagtcctactgtattagcaatagttttatcatcacctgtagtagaaagacccttgattgtttggtttgcttgcctgctttcaatataatttttattcgatcttgttgccttgtacctgattatttacatgattacttgtcttttttgtgttacagtagctgtttttatttaatcttgttgccatgtacctagttatttacataatcttatgttttctttcgtcacttgcagggtgcttgctggtatcattacaatctggtagttttagtggttgggcttgacttcctactattcagaaacacagtaccgagaagtctttaggtggggtcaaagatggtgtcgctgaagttgcaaaagcgccttgccgcgagctacctcaagtgtgggaaaggcaaggtgtggcttgacccaaatgaagttagtgagatctccatggcaaactcccgtaagtattatccactgcttggttctgcctggttcgtaatatgtttgacttctgctctgatttttgctattcttgtttgggtctgtgttcagctgtgatcttgacatcatatgagctgtggcgatctgtttgtagtgttcttggtccatttttctgctgttgagctttatagccgtcaaaatgggtagcacagttcactttatgggcatggtcaaaggtggatactttatgtagtttgaatatgttggatcaaacattattcttaccgccatggtttttaaagcggtaaggcggtccaaggcgttggaccaccgctacgcctaggcggcgcctaggcgttagaccaccgtccggacgcctaggcgacgccttaagaacagagcttaccgccaccatgttatagtgttatttacctgccaccacccttgaagacactattggctgtagctgctctagttcgttacgcgtgtacccgtgcagtctctaatttgtatatgttaatagttaacctgatgcagttgtagttctcttgaaataacaattccagtttatgattgtttttatgtattgtttatgcatatgtgattgtagattttggctaaggctggtattgcctgtgatcaaattgtgaatagactggaagaggaagcaataccattgcctagcttgacataattgtaacatttaatgctcctattattggtcactgttaatttttcattgattattatctggctgtctcttgctaaatatttgcactgcttagccaactctgattttgtcatgttgtttctcaaatctcaatttatcatactgaccatgatgggatagtactcaagtcttttacattcctgggattttgctgtgctttgccatgagtttatattttacattaacatagtgcattagagttttgaaattgtaggcaagtagagttgtttctatgttattctgctttaacttttaaaggaacataaaggggtctatgtttttgcaatacttacaggccagaatatccggaagttggttaaggatgggtttatcatcaagaagcctcataagatccactctagatcccgtgcaagaagggcacatgacgccaagcaaaagggacgccactcaggatatggtatgctgctgcaactcatttatgtcacagttctgaagggtgagtaagctcgtggtaatccgatgcctgtataggtaagcgtaggggtaccagggaggctaggctacccaccaaggttctgtggatgaggaggatgcgtgtgctgaggcgccttctccgcaagtatcgtgaggccaagaagattgacaagcacatgtatcatgacatgtacatgaaggtcaaaggtaacgccttcaagaacaagagggtgcttatggagagtatccacaagtccaaggctgagaaggccagagagaagacactttctgaccagtttgaggccaagcgcgccaagagcaaggcgagccgtgagaggaagatc

SEQ ID NO: 258 - DNA, 1197 bp, Zea Mays
gaccattttggggcgcacatataagccaccgccgcctcgcatctcctcctccgccccacgcagctgaggcgttgatcctcaccggcgtcgccatcgtaatcgccttggacagcggcaccagaacctctgcctccgcaggtgagttcgcctccaaacgcatctccttttccgcttctcgatccgttagggttttaaccggaggctgaggttgttctaccagctatatcgatctgcccttgtaaggctgaagcttcagatgtttaacaattggagcaactattcaacagaattatggaaagcaagtcctactgtattagcaatagttttatcatcacctgtagtagaaagacccttgattgtttggtttgcttgcctgctttcaatataatttttattcgatcttgttgccttgtacctgattatttacatgattacttgtcttttttgtgttacagtagctgtttttatttaatcttgttgccatgtacctagttatttacataatcttatgttttctttcgtcacttgcagggtgcttgctggtatcattacaatctggtagttttagtggttgggcttgacttcctactattcagaaacacagtaccgagaagtctttaggtggggtcaaagatggtgtcgctgaagttgcaaaagcgccttgccgcgagctacctcaagtgtgggaaaggcaaggtgtggcttgacccaaatgaagttagtgagatctccatggcaaactcccgtaagtattatccactgcttggttctgcctggttcgtaatatgtttgacttctgctctgatttttgctattcttgtttgggtctgtgttcagctgtgatcttgacatcatatgagctgtggcgatctgtttgtagtgttcttggtccatttttctgctgttgagctttatagccgtcaaaatgggtagcacagttcactttatgggcatggtcaaaggtggatactttatgtagtttgaatatgttggatcaaacattattcttaccgccatggtttttaaagcggtaaggcggtccaaggcgttggaccaccgctacgcctaggcggcgcctaggcgttagaccaccgtccggacgcctaggcgacgccttaagaacagagcttaccgccaccatgttatagtgttatttacctgccaccacccttgaagacactattggctgtagctgct

SEQ ID NO: 259 - DNA, 2289 bp, Zea Mays
acacgaaaccccagcacctcccatataatttgtctctcgtgcctcgttgcgtctttgtcgagtctaaccctagcgcgcgccgccacacctgccgttgctaccgccccgtacctcgcttgctttcccgtcgccgaaatggtatgccgcttcacgccttcacctcttcctcccattcttcgtgtgaccttgtttgtcgtacagccgatgcccagttctgtctggccgcttgttcgcgcgagatctagagtgcttgacttcgcagtccagctcctgttcgatatgtattcggccaggctcaatagtttagttttcgggattaggatcatgtacaacaatcatactttggatcagtcgttgtgttcctgtgttttcatgtaaatctaagcccgttggtcgtaacactgttagtctggaatagctcgcgctttaaagtgcaatatattgctagcctgctgctagggtcatgcgggtatttggaatgtgctagccttgaatatgcaatttagggtggcacgctgccttttgtgcattatatgtttggagaagttgctatctcaggtttcctagggtgaggcacaaactgtgtaaagctaaagggtaaaggccacaagacatcatccaaaaactgctacagtaagggcaggaagctaactatatgtttctactccacatttaagccctaaagtgttcttggtgatcttgttaattgacaacatgttgaatgtaaattccacacagtattttatgagtcctttgaggtatgctgtatgtgtggttttcgtccttagtgtttgtgcaagttctagcaaattggaaaaattcattgttagtttagtgcacaaaggcaaactagcctgacacctttgccatgccatcagtagccactccactgcaccaggcagcatgcaacatgaaagtagtatccaatgcaaagcttagcctttgaacacctaatgtataaatcagtggcttataatacttttctcctttgttgattttagttattatgcctttgcttgtcaaatgtatatcgggtaaattctctcttgctgctagtggagagttaatagcaactaactgaccttaatgttttttagtggtctacatatctattgtttaagaaactatatttttctcttgttgattgttaaggtacctgagtgtgtgcaatcttttatattgatactaactttattcttgaaaagttgcagctttacacttaccagttatattgcattgaataattttagtgagcagttgtgatttattttgtttttataatgcctatgcagacgaagcgcaccaagaaggctggaattgttggcaaatatggtacatgctcaagaaacatgacatatttcccaatatgtgtgtctgggatttgatgttaaccttgcaaattatactgttgtaggaaccaggtatggcgctagcttgcgtaagcaaatcaagaagatggaggtatctcagcactccaagtacttctgcgagttttgtgggaaggtaggtcttctggtagttacccaccctgcttctgtatttgagtttttttttatctttatgtactcgttatcaccactactggactgttatgaactgtaagctgcagactaatttttacacacatgaaagcaatcggtcttaaatatatttgtctgtttataagttcatatatttgaatggtttataagatgtttaggcatgtcgaacaatgtttctaatatagatgtgtcccacttttgctatgttgtctttccagtttgctgtgaagaggaaagcagttggaatttggggatgcaaggactgtgggaaggtcaaggctggcggtgcttacaccatgaagtaactttttgctgactctcatcttgtgttccataaccgtaatattttgttaagcatggcccaattctgttttctgtatttgcagcactgctagtgcagtcactgtcaggagcacgattcgtcgcttgagagagcagactgaagcatgatttagcttgctacatcagggttctcctagttgctgttgtcgggaatgttgagctcctctagttggatcacgagactggctaaaagttgggtgctaagatttgtagttggttaccgttgtgaatttctcaagtgatattatcctatgcttgtctcaatgactcaaatttggttgtggtttctatgcttttggctgtgtcaatggtttgccattgttgaaattcaacccttaatgctgcctcttataataaaaagtttttttattggtctggttcagaaagcaagattatatacgcttct

SEQ ID NO: 260 - DNA, 2289 bp, Zea Mays; identical to SEQ ID NO: 259

SEQ ID NO: 261 - DNA, 2132 bp, Zea Mays
ccgcttcacgccttcacctcttcctcccattcttcgtgtgaccttgtttgtcgtacagccgatgcccagttctgtctggccgcttgttcgcgcgagatctagagtgcttgacttcgcagtccagctcctgttcgatatgtattcggccaggctcaatagtttagttttcgggattaggatcatgtacaacaatcatactttggatcagtcgttgtgttcctgtgttttcatgtaaatctaagcccgttggtcgtaacactgttagtctggaatagctcgcgctttaaagtgcaatatattgctagcctgctgctagggtcatgcgggtatttggaatgtgctagccttgaatatgcaatttagggtggcacgctgccttttgtgcattatatgtttggagaagttgctatctcaggtttcctagggtgaggcacaaactgtgtaaagctaaagggtaaaggccacaagacatcatccaaaaactgctacagtaagggcaggaagctaactatatgtttctactccacatttaagccctaaagtgttcttggtgatcttgttaattgacaacatgttgaatgtaaattccacacagtattttatgagtcctttgaggtatgctgtatgtgtggttttcgtccttagtgtttgtgcaagttctagcaaattggaaaaattcattgttagtttagtgcacaaaggcaaactagcctgacacctttgccatgccatcagtagccactccactgcaccaggcagcatgcaacatgaaagtagtatccaatgcaaagcttagcctttgaacacctaatgtataaatcagtggcttataatacttttctcctttgttgattttagttattatgcctttgcttgtcaaatgtatatcgggtaaattctctcttgctgctagtggagagttaatagcaactaactgaccttaatgttttttagtggtctacatatctattgtttaagaaactatatttttctcttgttgattgttaaggtacctgagtgtgtgcaatcttttatattgatactaactttattcttgaaaagttgcagctttacacttaccagttatattgcattgaataattttagtgagcagttgtgatttattttgtttttataatgcctatgcagacgaagcgcaccaagaaggctggaattgttggcaaatatggtacatgctcaagaaacatgacatatttcccaatatgtgtgtctgggatttgatgttaaccttgcaaattatactgttgtaggaaccaggtatggcgctagcttgcgtaagcaaatcaagaagatggaggtatctcagcactccaagtacttctgcgagttttgtgggaaggtaggtcttctggtagttacccaccctgcttctgtatttgagtttttttttatctttatgtactcgttatcaccactactggactgttatgaactgtaagctgcagactaatttttacacacatgaaagcaatcggtcttaaatatatttgtctgtttataagttcatatatttgaatggtttataagatgtttaggcatgtcgaacaatgtttctaatatagatgtgtcccacttttgctatgttgtctttccagtttgctgtgaagaggaaagcagttggaatttggggatgcaaggactgtgggaaggtcaaggctggcggtgcttacaccatgaagtaactttttgctgactctcatcttgtgttccataaccgtaatattttgttaagcatggcccaattctgttttctgtatttgcagcactgctagtgcagtcactgtcaggagcacgattcgtcgcttgagagagcagactgaagcatgatttagcttgctacatcagggttctcctagttgctgttgtcgggaatgttgagctcctctagttggatcacgagactggctaaaagttgggtgctaagatttgtagttggttaccgttgtgaatttctcaagtgatattatcctatgcttgtctcaatgactcaaatttggttgtggtttctatgcttttggctgtgtcaatggtttgccattgttgaaattcaacccttaatgctgcctcttataataaaaagtttttttattggtctggttcagaaagcaaga

SEQ ID NO: 262 - DNA, 717 bp, Zea Mays; identical to SEQ ID NO: 87

SEQ ID NO: 263 - DNA, 2500 bp, Zea Mays
atggccaagacagcaaggcaacatgccaacagcccacatgtatggtcacgctcatggctaactacagcccacaaggccacaacccgtcaggcgtcagccacagcccacaagccacagcggtcgtgcagccaacatagctcttgcagtggcttgcttgcttgatcctagatacaagaaaaagttggtagaatatttcatgttgaagatttataaggacagtgctgtcgcagaactcactcgctttatggatgttgtgaaccaattattccaatcatatttgaccagtacacgtgatgtttctattactcaaactgatcttgctgcaagtacatctaactcaatttgtataaatactgacattgacgagtttatatatgaagataatgatgcagccaaaggtgaaataaatgaattggatgtgtacatgaaagataaaccaattcggtgggttgatcctactggtaaaggtctacaatttgacatattatcatggtggaaggccaaccaagttacatatcctgttctctcgcgtcttgctcgtgatgtattggctgttcaagtctctaccgtggcctcagaatgtgctttcagttcgagtgggcgtgttgtgagtaaatatcgcagccgtttagagcctgagactgtggaggcattagtttgtaccaaagactggaatcttgcatctaacaaaggtaaaactgacaatacatacttgttgttcctgttttgcttgctgctaaatattttatcttatcacttttagatcgcaatgataaggtaccgtcaattgttgaggagttcatggcagatgaaaatgaatatagctcgacaattgaagaggttagtatttatttcaattacttgctgttgttgacaattgacatactatgtttcaatttaatatgcactatctgtagggacagaaccaagttgacaatgaaggaaatggtgaggatagtgaggatgagggcagcgatatggagttatgatttttctgcagctgttcatgggagtctgtttcacaagtttcagtgctctgaagcctaagatgatgcttaaatcttggttttcgacattttggcgctagctggtagctgctacacttaatccttaatgtagtaatgacaatgtagttctagtttggagaggcatgtactattgtgacattttggcactagctggtagctgctacgacattttggctgctagctggtagctggtagctagttctattgtgacatgtacgcagtatagtacttagcatttagcaatgctgatggctcacgctcatgactgcttgcctatttacttagctttatctgtctattagcctgatcggttgtgacatttgaatctggatgctatatatgaatgaatgatgtgtctttatatccgaagaaaatattcgtaaccgaagatattcgcatccgattcgttccgtattcgatatgtgacaatctgtatccgtaaccgagacaatccgtattcgtattcgtatccgaagatattcgaattcgaatccgaataaaaaaatgaaaacaaatataatattagtaatatccgtccgtatccgatccgattacatccctagatgcggtggcgacgaatacgataggacaggaggaggccgcggcaggcagaggcagccggccgaccgaccgaccgaccctgggacgtggacgtggtgacgcggtcggggaaatcaagactcaacagaccgacgcggcgcccgggtcgtggcgggccccggtgcttcagcctccgcggggccgtgccgaccaaacaggagcagccgcgggcgggactgcgggaggaaaggaaaagaaaggccactcggggcggggcggggcggggccgggccaagccaaacgcggagtcgccgaggaggaggacaaggcagggcagagagggagggaggaagaggaggaggagcgggatgcggcgggcaaggccgccgccggtcccggtcccgatgacgccgggggacgctgggccggaggtgaagtaccgcggggtgaggcggcgcccgtcggggcggtacgcggccgagatccgggacccggccaggaagaccccgatctggctcggcaccttcgagtcggccgaggccgcggcccacgcctacgacgcggccgccaggaccatccgcggcgccgccgccaggaccaacttcccctccgcctccatctcagccacggtggcgccgccagccgcccccgccgcgacgtctagccacagcagcaccgtcgagtcctggagcggcggcagcggcggcggcgcgcccgtcgggatcctccgcgccccggccgccgaggaggactgccgcagctactgcggctcctcctcgtcggcgctctgcgaggacggcgcgtcgggcccgggctgtggcgacgagaccgccgcgccgccgcggtgctccccgcttccgttcgacctgaacgtgccggaccccgcggccgacgagatggactggcgctgcgacacgctgctgcacctgtag

SEQ ID NO: 264 - DNA, 3441 bp, Zea Mays
aagttggtagactattgtctgatccgcaccgttggctgcgtcacattctctacgcctcgtgctccttcccttctaccgttcggctgcgtacccgcgtctccccagatccgctgccccgccctctcgacgcggcaattcctcgaacgccccgcgcgagccacgccctcgccgcccatgggctcgctcccggcgccggcctcggcggaattcgccccgcggccgcgggggcgcgccacggtggtggcgtcggacctggcgccgctcttctccgcgcagcgccggcacctggaccacttcttcgaccgcctcgacatggcgcaggcggcggcgttcgcgcaggcgctgctcgacgcgccgggcgccgtcttcttcacgggcgtcggcaagtcgggcatcgtggcgcgcaagaccgcgcagacgctggcgtcgctgggcctcgcgcgggccggcttcctcgcccccgtcgacgcgctccacggcgacatcggcgcgctcttccccggggacgtcctcgtgatcctctccaagtccggggcctccgacgagctgctcgcgctcgcgccctgcgcgcgcgccaagggcgcctacctcgtctcgctcacctccgcggcctcgggggatgactgcccgctcgccgcggcctgcgacctcaacgtccacctgccgctgcagggggaggtgtgcccctttggcctcgcgcccgtcacctccaccgccatccagatggtgtttggggacaccgtcatcgccgccatcatggaggcaaggcgactctccagggaccagtacgcttccaaccatcccgctggcaagatcggcaagaccctcatcttcaaggtaatcaaatcaaccacctctaaccctaacataaacaggttgccggcattattacagttactttttttagaaacgttcaattaccttgtgccgacacacagtgtgggacatcggatcggatcccagagagaaccagatgctttatcactgctaggattccttcaccgatgcatgtcggtggcaggggggtcggttcagaattggctctggttaaatgctcaatacgattcgatagtgttgttgctatccaaccgacattttgtttcaatttgtgactacgtatcgtggtctttttcatatggaggggatcttattacttgtcgttttcgcagtcttttcatcgctacaagaagaatacaacaagctaccaaagcaaagaagaaaaatacaacaaagtgcctcatcatttgtgtgcattttttgtttaatcgtggccactgtcttcagatgccatagcagaggatgataagttgggtgtgcataacttgtcatatttgaatgaacgcgttgtttctgttcatctgcaatgtatttactgacttctaaaacaagagtagatcttgtctcttcaaccatctgatttctgcggggctcttgttaaatcggcatgtgcaatatcttgtgctgccacccagtgggagacataggatgccagatgcttgttactactaggattcatttactgtttgcgtgtcgtcactgggagtggtccaataaatagccctggtgaaatgcgctttaggattggataattttgtcactatccatccaacatttttttttgtttattgttatctgcaatggtcctttttatatacacatgccaagaaaaacaaaacaaaaaagcacctactcatttgtgtgcattatcgattgtctaattgtggtagttattaacaagctatgtagctctgggtgatgtgtaaggccagctgttcatgacatgatatatttgaatgggatccttgttctcgtgcaaagtagttactgaaaactgaaacaagttcagatcttgtcttcccagttatctgatttctgtgggtgttgttattgatccagcatcagcctgtgtgttattttcttgtttctataggtgaggtgtgtcttttagactttttgttcttacacaaacaccctgcaggttaaggatgttatgaagaaacagaatgagcttcctctgtgcaaggagggagatatgataatggaccaactcaccgagctcaccagtaaaggttgtggttgtctgcttgtggttgatgaagagcatcatttgattgggaccttcactgatggtgatctccggcggacactgaaggcaagcgggccagctatcttcagtctcacagttggagagatgtgcaacaggtttgtcaacattaacttgctataaattacctagcatgtatgaattccttctctcataagcacagtggtacttgtaggatactgatatttttttcagtgcatctggaatttggaaatggcaaagtagaagcagtactttttttttgtccttttcatcttttgttttcatcctagttctgaagtattgttgtttcataaaccataagttcatgtgtattaacctttacagattgcagtagtagctgtactatgaaaaacacaagtctctctctctatccctcaaatagccgagttgcctatatcctcgatacatcatgctaataaatgaaattcaatatgatatgctaaatgtttattatgcattataagctccagggttcattgtttttttgcagaacggtatatgtatatagctacattgtgttttattgagaataaacatttgttttgtcagcagcaataacttcaatatacaatactgacaaacagttttgaccgagaataagcagttttcttaccatgtccgttttgttttctcaagagttggttttcattgctctgttctgttcatttctcatatgaaatttgtttgcgtgtacaagctttggtgtaagatacactatcaaagaaagaaaaattatgtctcgttattgaactggattcagaacctctcctgcttttctgatctttcaagtcgatacaccagggtgcatattctcatgttcatcgtgacctccaacgaaaataaatgccttcagtgttcaatatccattgttttgtgtagataatgctcagttccatatatctgtggtgtcacacatctttcattgcatcagtggaacttgttcctagtctaagccagatgctagtcttatctaacttccctgcattgtctaacaggaacccaaggacaatcactgcggaggcaatggcagttgaagccatggagaagatggaggcaccaccttcacccgtgcagttcttgcctgttgtcaacgagaacaacgtcgtgtgtggaatcatcacattgcatggattggtctctgccggattgtagacttgtgtggcaccattacctgttagctagctgttaccgctggagtatttatgtggagcctgaactcttcagtgtacccttatgtacagtatagtggtcgctaagaggaacatggtacactgcttataatgcttgtgtttttgtacttaattttaaatgccgattgccttggtttctcttga

SEQ ID NO: 265 - DNA, 1294 bp, Zea Mays
ccttggcatgctgtcagtccctcccaacctccattccttcctcctttgccaatgcagctctgatctctcctacctgagaatgtcagtgtgagtggccattccatctgcacaacatcctcctccacgcacgcaaaacatacaaaaaggcagaagcggaggagatgaaggcaatggccgggccaaagctgctcgtcgtccacgcgtcgtcgaacaaggccctgaacgggatggcgcccacgtcgccggcgtcgcccggctggtcgcggtgcctgtggctggtggtgttcctggccttgttcacctgcgtgtccctcctgaccgtgctctccacggcgcgcgcctcggccggggcgccggcgtgccaggcggcgtcgctcacggccagcgctgccggcgccacggaggccggcctgccgcggcacgtgttcgacgcgctggtgcagtacgcggcggcggcagggaacttgtcgtcgagcatgccggagccggacgtgcgcgcgatcgcgtcggtgctccggcggcgcgcgccgtgcaacctgctggtgttcgggctgggcgcggagacgccgctgtggcgcgcgctcaaccacggcgggcgcacggtgttcctggacgagaacccgtactacgtggcccacctggagggtaagcacccggggctggaggcctacgacgtggcctacgccacggcggtgcgcgagctccccgacctcctcgacgccgcccgtgccgcgcgcgccgctgagtgccgccccgtccagaacctgctcttctccgagtgccgcctcgccatcaacgacctccccaaccagctctacgacgtcgcctgggacgtcatcctcgtcgacggcccgcgcgggtacgtgccaatgcacatgcaccgttgcatgccggttgttggattagttaaggaaggaagccaatccattaactagttataactacctgacgattttgtcatgtcgtaaaggttcatggaggggtcgccggggaggatgtcggcgatctactcggctgcggtgatggcgcggaccaagggcgcggagacggaggtgatggtgcacgactacgagcgggaggtggagcgcgcgtgcggccgggagttcctgtgtgacgagaaccgggtcacggcgaccagcacgccgtcgctcggccacttcctcgttcgcggcggcgccgccgccaaccgggaagccttctgcgggccgcccgccggcgccgcccagaaatcgaaaccgagctaagcgagtcgtagtcgttacttctcaacgaatcaagctgattcatcagaagt

SEQ ID NO: 266 - DNA, 4241 bp, Zea Mays
tgaaggaaaacgggcgagagactagacaaaccatagaagccgccactcacgcctggaagcatctggaggcgtggcacggcagccgtcgcccgccacaccagcagcgaactgcttcccggtgcccgcggcggcgaagcacaggagagaggcggcgagtgaaaccgatgacgccgccgatggatccgcccgacgtcgagatggagatggagcccgcgccccagcctccggctccgacagcggtcggggaggggtggagcatgctgtcgcgcgcccgcgggctgctcgaggagggcaaaccgtccctcgctctgcaggcggtgagaaccctcccccctctccccttctccgttcggtctccatttcccgcgctgtcaatctcgcgtttgtctccaccgtcgcccggggtccggcgatgaaatggggaatccgtggatttagtttctttcgtcacgtagacgtattgaaacctaatcgatcgcgtggttggacgatcgcggattcgcggtgagcttcccgtagttcgatctcactttggcccgtccgccttgaggtttggcgcggagaggccaaatggaggtttaggtgtaatccgttctaggtcttagagtttgggcttggttaggtatgattcgttctaaagatgatgctacgggtagctgtttaggtgcctggctacttttgcagctatccctttcgaatctgttgtctacctgtttcttgggcaagcgaaaggagaagggatgaaaggaaatcgtggctttatgcacacacatcttaactactgcctttctcctttgtctggaactcttgtaacttatccttgccaaaatgtgtgtttccaggcacagacatatgtagttgctgagtaatgaaaagctgttgggttgtagttggtagacccaagaaacacgaactcgactcgtccaaggtggaagttgaacaggacacagaagacagaacacaagaacactcgtcgttttcgttggacggactgaatagccagcggcaccgccttttgggtgttttcttttatcctatcgccgagacagttgcatcgcccagagcccgatccttctgccatatccgcgtcttccgccatgactcagcatgaaacacgcggaagccgctggagtggagaaccgggcaaacgcgcccacgcacgctcgatgtgcgcggtgaccgcgctccgacgtggctcatgacatgccctggcttgcgcccatttatttgcaagaattcgaactcttatctactgccaaactccatggtcagttggtcacgaagctgaagtatccaacagtagttgccgagtaatgcaaagctgccgtgttgatcattggcaactcatctatcgtatcccctcgctatactgttgatttatgtgttcttgctaattagaccgtggcactgtgcagttgcgtctagctctgttggcattgcatgcattgcatgcattgctgattcgtgacatgtggcgagtttccaatacagtacaagccctttctgttagagttttatccattttttgttttttttttccaattctgaacatgaatgatctggaaaattgaatgactaccatccggaaaattcatggatgcagtgtgttatctgagcattgatggcatccgaagtaagggcctgcaacttaatttcaagaagccgagtcaaatcgagctttaagagtaggtcttacttccctcatgtggtgaaccttactagttagcaaattatgttcctgttgattgaacactaagagctcatcagagacattatttggataaaatgcttaacacaactgaatctgatctcaacgacagcttaggtacaccttaacatgctgtgtgatcttatgtttgtgtaaaactggtggtgtcctatcccatatgtgcaggactgcagggcacatttgataatgatgttcttctattccatatcaaccattttggattgacctgttaaaaatgactatcaaaaccttttataggtgagtaagggtgaaagtagaaggcatggttggggaaagttgaagaaagccacagcccacaattagaccctgtttgagagctcatttttaaacccacagttttccaataccacagtctaataattggcatgagtgcatgacacaaccatggtttttttacagcagtcaatcgaacacctttttggtgccatggttttttatgttgtcatcaagcttcattcaaaagatgttgactggcgatcatataagtcaaataagtcacaacaattcacatggactaaaaagaaacaagtgcgtgacagtttacatgaaaaaagcacttgacagaggggtgcaccaaagtttttcatactccaaaaataccgtggtattgccaaaaccaaggtttttatatagtgtggttttaaatggtctacccagcaccttttggcctctaaaaccatggtactcttaaatagcacagtattgtcttgggactaggaaaatacagtatcttcaaacagggcctcagtgtttggtttgcttataaaattatttgagtctacactattttacataggaatacagggcaatataggcttaacgaatcttactatatatgtattagtgtgcgatgcaaaacatactctatctgagttctcgagtagcaatcctcaggttctgcgtttgaattcctgtgggagtgaattttagcctgggttaaaaaaatccctttgtcgttctaagatcaggccctggttagggttgttctcacatgggctatagttccgttgtgtatgggtggggaagggtacgggggtttctcgacctgcattagaaggtcgcaaaatgcctggaggctgccttaagcccccccccccaccccaccctccacccccaccccacacacacgtgttggaatttccatatcttgtttggattagaaatgtatagcatattcctgatgcattacatggattgaatgaaatgcacatgttttctgtggatcagagtagtaggctaattacttaactgcaacaccacactatgtcattagcgattcgccgattcctgcctgtaccccgagctatgtacctatgttagtgggactgattttttcagaccaacatctacccaatatgaggttatgtcttacctgttgcatgtgagatcctatgattgtggtgatgtgcgagtcataataacattgtaggatttgttggtaatgtgacgagttaagtattctggtctattcaaatgcataattttcattttgattcctgctggaagacttctgtttcaattttcttcgtatcccaacaatccagattgatactgctgctttccgtgacgatggttacgtgatgagtcttggtaactaaattaacctttcgaactttacttgctatcttgagactcatttatctgatttcatgtccatttcatctgtatctgttatattgattatcatcttatgaaactatgcaggttctcttggccataagatctcaaggcggtgaacaagctctcatgcagacattgaaccgtgcacgtgaactctatgcacagagattgcaggccagtcctagtgttgatgagcttgcctctttgcttgcccaatgtgccatagcagaggctcagtcatcaaatactaaccctccacaagggcctgggtcagaccctgtcaatatgctgaattctgatgaggcctgcattcttgctgagagtggaaggaagcagatcatcctggacgcatttgctgatgggagcagcttcatttgcttgaaatgtggggggctctttagcacatctcgcaaggatgagcacttagcctactggtgcgggactgcatgatcctggttacgtcttgctgtggtatatccatggtcacacctagcaatgaaccgatgatcatgatacccgtgagattttgtataaactttgttctgttccaatccgattactgcttctttactgcggggatgccagaggcacgtctgttaagtcgtagtaaatacatttgccgatgacaaactttatgaacgaaagtttccatctctatccgcttgttgtacttgtgctttcggctgatggaatgtgttgagatgtttggcatggtcatcaaattctaatagttgaatgtgacgaagcaatgttcttgtggttagctctgatctgatcacgcaaatactgaagctgggtagaaagtttggaggaactgatgatatgccccttcgctttcggttttattgagttgaaaactggatttagcagt

SEQ ID NO: 267 - DNA, 848 bp, Zea Mays
gaagagaaaagaagggcggtgccctcttgagcccggtgagatcgctgtgatcctgcgggcactggggtacacgagcggcacacagatatacgtcgcgtccgggcaagtgtacggcggcaagaaccggatggctcccctcaggaacatgttccccaacctggtaggcaggctcaaatccacttcagattgtgtcaagctgaagccagtgataactgataagccactgccgtgcattgtgcatcgctgcaggtgacgaaggaggagctagcgagcgcggaggagctggcgccgttccggcggcacgtgacgagcctggcggcgctggacttcctggtgtgcctgcggtcggacgcgttcgtgatgacgcacggcggcaacttcgccaaactcatcatcggggcgcgccgctacgcggggcaccgcctcaagtcggtgaagcccgacaagggcctcatgtccaagtccctgggcgaccccgacatgggctgggcctccttcacggaggacgtcgtcgtcacgcaccgcacgaggacgggcctccccgagcccaccttccccggctacgatctctgggagaacccgctgacaccctgcatgtgcagggcatgagacgggccatccctcagatcagagtggccgtctggccgagtcctcgtcttcgctaggctacgactacgagtagtctcgtgctcacttccatcagcgcgcatttcagcgagcatatgcttctactagttaaacacctagatttgtatgtatttggctggcctaatctgtagtttcacatagatcacttcatgctgaaaatgtcttggacaaggcagtgaatgaagataacatcagtaacg

SEQ ID NO: 268 - DNA, 1751 bp, Zea Mays
gttcgctaaacctcgcgcacagaaacacaagcgagtaccagagcagctaggagtggtcagcaatggcgcagcttaaagcagccgccgacgagcagcaggaggcggcgctgcacggcgtcgcctccggcggcgggaacgagagcaacaagaaggcgcgcgcggggctctgcggcctgctccgcgagcgcaaggtggtggacctggcgcgggccaagcggcggctggtggaggttccctacaccgcgacgctggcgcacacggccaacgcgctcctggcagcgcgcgtctctgccgtggccgtggctgcgccaccgggccactggatcggcgccggcggctccatgatcctcgagtccgacccggccaccggcgccgtccgcaagcactacatcggcatggtgaacatgctcgacatccttgcccacatcgccgaggccagcgacgacgacgaggcggccgacctcgaccgccggatggccgtgccggtgtcctccgtcatcggacactccctcgagggcctcactctgtggacgctccacccgagcaccaggtacgccggccgatctccagctcacactcgtatttttcttcttcttcctcgcattgtacgcaatctgcgcgtgtgcgacatgttcgttgcgttgcgccagcgtgctggactgcatggagacgttcagcaagggtgtgcaccgcgcgctggtgccgctggagagctcggcggacaacgtggtggcgctggagctggtggagtcggcgccggggtaccggatgctcacccagatggacgtggtgaggttcctcagggcgcacggcgcggagctcaggggcgtgctgttgcgcaccgtgcgcgagctcggcgccgtgaacgacaccgtgttcgccgtctctggcgttaccaaggtgatcgacgtcatcaaggcgatgcgggcggcgtcgctgaccgccgtgcccgtcgtggacgccgtcggtagcggtacagagacccttcaatacgtgagcactgcacgcgcctccgatccgaacacgccatctcctgccggatttcctcctgtctgaaattcctgtcgtgctgctgcaggggagcgggcaaagggcggtcgagacgttctcggcgacggacctgcgggactgcccggtggcgcggctgcaggcttggctggggatcagcgtgatggagttcaagaggaaggtggctgagtaccgcgccagcaccaggcttgtggtccccggcgccgacgccacggacactggcacccctgtcgccgggtacgccgacacccccgcggctgccgccgccactgacgaagagcagagcgagcagcaggagtcggcgctggtgacgtgctcccaggagagcaccctcggcgaggcgatcgaggcggcgacatcgaggcacgtgcaccggctgtgggtggtcgacgaggaagggctcttgcgtggggtcgtgtcgctcaccgacatcctccgggcagtgcgggaggccgcgctcggcgaggacctggagctgcacagcatcgtgccgtgagcccgtgggccgtgagtcgtgacgtccaagaacaagctcgtagctgtttctgcccatagtgtccgtccacctgtcgtgctcctgcagaggagggggaaaagggcgatcgagacgtgttggcgacggccgaccggcgaccgccgccgagctcgttttgccttgttgctttgtttgttatatggccctggctccgatccgggcttcgtatttcgttgacaggccttca

SEQ ID NO: 269 - DNA, 588 bp, Zea Mays
atggctctgctcctcgctctcttactcgtgctactcttggccaccggtaagctaccctgatatacgaatctattcatgcgttcgataaacaccaccgttatcaattagatctcgctccgatcccatttttacttgcttaactgtgctacacatgtctatatatttaggtggtcaagccgacgccgatgagccggcaacgtcacagcagcgcgctgttccggcggagcaggcgccggcgccgaagggctacgaaaccctgagggaggaaccggcaccaaccggcggtgcgtactaacaagaacgcgtggccatgcatattgtagtatctgtttcttttggtcgattgtttagccttttttctaaactgaaattcgtttacccggcctgctgccccaaccccaaatataataaatggaaggtcaccgtcaccgggagatcaagatcggagcatgcttccccatcagcgacggcggcagcagcgctttctcctgctaccagcggtgcacgagcaaaggctacgccggcgggcgctgcgacaccctgcccagcggcttccccggcgactgcttctgcatcacgtacgcttga

SEQ ID NO: 270 - DNA, 2353 bp, Zea Mays
atgacctttagaaggtctattgagaccatcagcagatacttcagggaagtattgtatgttgttggtgaactgagaaatgaaatgatcttgccaccttcaactgctacaccaaccaaaattagagatagccacagatggtacccctatttcaaggtcagccatccaatcacaccactactaatcccttccttttcatgtgtagggtttgtagtaacaaatgtttgccctaatgtgtaggattgtattggtgccattgatggcactcatgtgctagcaagagttcctagaaatcagagagctgccttccttggcaggaaacacaccacaacacagaacatcttagctattgtagactttgatttaaggtttacatatgttcatgcaggctgggaggcatcaagcacatgatgcccttatcctcttgctgatgcccgcgagagagaagatggtctaaaagtgccccaaggtaaaaaattagtattggtaaacacaatacacacttcccttggtattccctatatatgatctatgatgttaggtaaatttaccttgtggatgctggttatgctgtcaggcctgggtttttacccccttatcgtgccacacggtaccacttgagtgaatatggggggaggaatccacagaacccaaaagagctcttcaaccttagacattcatcactaagggtgacaatagagagggccttcagtgctttgaagaacagattcaaaatattatacaacaaacctttcaatccatacaagacacaagtaaagctagttctagcctgttgtatcctccacaactggattcttcgtcatgggaatgatgaacatattccactagaagacacatgggctgcaaatcaagttcatgagggagctccccttgaccttgtcatggacaatgctgcctggtctgctaccagggacaattgggctcaatagatgtggcaaaatagaggatagtggtcattatgtactatgctaagttgctcatagatctgtaagatctagttccatgctgagaacattgtctattagcaatgatgaactatataacagttctgaactcactttctttgtggggatagtggtcattatgtactgtgctaagttgctcatagatctgtaagatctagttccatgctgagaacattgtctattagcaatgatgaacattgtcactttctttgtgtgatgtgcctagttgctaatgatgacattacttacatcctgataccattgtcaactagcaatgatgattactactacttctacttctactttcctatgctgacattactactatttctacttctactttcctatgctgagaatatctatctgtcttccccctaatcttttacttgttccagctatggttgacatggtgtctggggttgctagccagggggctaggcctgctctttggtggagtgccgcaatgtctgggtttgttctacgccgtttgttgacttgataggtactggggttaagactgacaagggttttaaggaaatccaccttaactctgttgctaaaaatgtctccgagttctgtggtcaagaagtaacaggccaacaagtgtacaatcaccttcgtaagtggaggtctaggtgggtcaaagttttcaaactaaaggacattagtagcgctctttgggatgaggatacctttgtcataagcttagaagagggtcattatgttgcttacatcaaggttaggaccaacaccttccatttctctaatttggtctaacttgaaattgctaacttgagttgctaactcaataggatcacccaaaagatgttgattacctcaataggcccatagagaactatatgcctatgcaaatcatatttggaagtggggttgccactggtaggtttgcaatgggttcaaatgagcctttgggcaagccaagtgacattgttgacatcctagatgatggcattgaagtgacctcagagtttgttgatgcttccaatctaactggcaagggaaagactgttgataagggtacccctggtgactccattgataccaagcctatgtccaacttagggaagaggaagaggtacatgactgatgaagatgttgttgtgttcaatgggatgaaagaggctgtatctgatgttgctgctgttgttcgtgaaagcatccatgctgaagcagcacctgggatctacaatgttgtaatcaactgtcatgggttctctagggaggctctcatgtatgccctaaaccacatgatggagcacaaggccacctccctggtgttcctggacatgactcctgatgatcgtgacctatggctcaagactttcctaaccaagcactaccacaactga

SEQ ID NO: 271 - DNA, 4701 bp, Zea Mays
cggaagcaaaagcaggccagcacaaaaccactcgatagaaaagcccccctcaaaacccacggcgccgccgcagccgcgttcacgaagcttggggaggcgagcaccccgatccggcgaggtgccgcgagcgaggcagcgatgagaggccgtgcgtcccatctccgcgcgctcctctcgcgagcgctctctccaagccttcctcctcctggtcgcgctctgcctcaggtaatcggcgtctttcccccatccttggcttccaccgagcgatggatctccgctcgcctttcttggagtgacgctgaggtgtcgtgactattttcgttcccgctgcaggtcactaggcccggtgcgtctccgttcggagctggattcgtggggcgcgcgcgcttcttctccatcgacgcctcggctgcgacgcagggcgggtcgaagccccctgcgccgccgccggcgggtactgcgggcggcgagggagggggtggtggtcagtctgggaaatctgaacaagcggacgccgggaaagccgtccgcggaggggtaagtgatggatccttatgcatgggcaaataaacgtgattgctctgaaatgttctatatggcacgaattagcagtgatctagagcccaatgaaacatgatggtttcttatttcctcaggacattccttatttctagactgtttaggtcaattatttatgcgagctaattcagaagcttttgctacttccttgcagccggtgtcttggctcagttttctactcctgcttgtgactggaggagggataatcgtgtactacgacaaagaaaagaagcgtcacattgaaggtagattactatggtgagttgtttgttatttgctgtcatgctgggactgcatttagtaatgcataggaatatctttcaatgttcatgttgtaccaaggcatattgaatggagtaaacatcaatatcagttagccacagaaactaaaaagtttatgttcagataatcaggaaacaaatctcgagatgttttaggtggatagtttacatgtgttcagtctagtaactaggtgttttcaaagttatgctcaagtggtagttcaacctagtgtatatctacactataccatgtctgctgtttcatattatcatataactatcgaactgtctaatcctgaatttgtatgctgagtccactcaaaatatctatctacccttctgaaatgttattgccatggctattggggatgttgctatggaaacaaaagtttctgtggctctgtgggtgtggtttcgacatgcactttttttgtcttcaagtgtcatgctgacggtcaactgttagatataaaatgaaattgaaattgtagtaggtgtgtagttttctttgtcttactaattcacaaagttaatagcttctgatttggcttcatgaatgttgcaccttgctacataatgcttctggaatgcattattcacacaatcaacacattgtcttatgttcattgttatgtccacttattatgagtgctgaactaggaattttaaagcttttatctattcttcaaggacctacttttcatgtgtagccttgtctgtctcagcgttttcatataaaaagcatctcctgcaggccccctttcaccgaaaaatgtatttgggggttgaggttttttcccttgctccagcagatcccccttcacatccctttttaatggttatcaccactgttttgtgccagcctccccaccccccaccccccacccccacccccccggttcatcttctggcaagcactgtgacatatactaaatacgccgctgtcccaaactgcttaatctgaagcgaacagtgcacccccaatgtacagctctattggcggagttgtattggcgatttggtagagaccctcttccataaaatctctgttgggcatgtacatctcttagactgaaaatccactttttatttttgtggaaaaaagatgtttatcatcaatgaaatcatcattaaagcaggagacaccttactgaatttgtgaccgctatgattgagcaagctaaggaccactctatgtttcatacgttccttggcaatcatcaattatttcttcattgctgtatgcaaaatcgggaaccattactcagccagttgcctaagcttgccctgccttccatactggttttccttttaacaataatttggccacaatctacactaatgtggaaaataggttaccattgatttgtgtgtattttcttttgtaaccactgcttgcattttcatactatcgttagcttttctgtaaatacatatgcatagcttttaagtacagttatacaaaagctgaactgaaaactaagtttgtgaaaaaaagtaaaggttcctgttcctctttccatgcttcttaatgatatcagtgaaaagccagaaaccattatagggcccgtagaaccattgtcagaacactttgtgcaaattgtatcttatattgtaacttgtatttttgttttaacaccattgcactatgacaaaatcattaccctctggttcagaaacagatcaccatttactatttagcgaaaattccaaagttttccctattttttcaaatggagatgtgtcctaaaaggagacttgaaaggatggaatatacccaaagatttagccttgaataggagtgcatggaaacagctctccatgtttaattctagccgaccccaacttacatgggataaaaggcttggtggtggtggtggtggtggtggtggagatgtgtgttttggaagtatttaattgaagtaggaaggcttgttctcatagctgtttatcttgtgtttttttctcttctgtcttatccagaattgaagaatagaacaagtgctgtgaagcctggacaatcagtaggcactgcagccattggcggtccattcaagcttttgaatcatgatggaaaacctgttactgaaaaggatttcttgggcaaatggacgctgctttattttggatttacacactgtcctgacatttgtccagatgaactccagaaaatggctgcagcgattgacaaaattagtaagtcaatttgagtcttttggtccttgggtacaagtatcttctctcaatatatcttcttgtattcatctggcactgttgtcttgcattatattgtcacttggaaactagaaggcaaataatagggtaaatgggcaagccaaaatgagatgtacatacaaggttatgtatttttgtttgactggacttggtgaaaatttccactgaagtgcctaagtggagctagtagacagttgaagttagcatatttttcagtcattataatatgttattctatgcagaggaaaaggcaaaactggatgttgtgccagtttttattacagttgatcctgaaagagatactgttgagcaggttcgggactatgttaaaggtgtgtgtttgcaattgtctcttaatgcttgtaatcattttaaattgtagccctttgacctcttattattttgcaatatcttgttatttcgattgctcattgctgatgaactatttgtgattcacagagttccatccagatctagtaggcctcacgggcacgacagatgaagtaagacaagttgcacgtgcttatcgagtttactatatgaagacagaggaggagggttctgactaccttgttgatcactcaattgtcatgtatgctatttctaatctccatcttgcacaatggctttaggcatttagctaattgtgattctgatgatactctgcaattgggatggtctagctcatgtcatttcattattgcacgatacgccatacctacagcatgcaaaccaaaacgaagaaaccagctaatttggctcttgttttttttaagattctgaatattatcttgggagactcaaatgggtatctagtaggatttgttatggtattggatactgtgaagactcagaatgttaactctagcctaccccaacttgcttgggataaaaggctgtgttgtttttgttgtattggatactgtgaaaactcaggatatcaaatacagggaatgtctcgatcccgataccacatgctggctgcagttgtgttctccttgcactcactgcagctatagaagacattgatttgttgatgcaactgctatgtttttatcattatgatagcgattaagatacatatatgttgtgtcaaaacactgactgactggttgttcatcttctttcaggtacctgatggacccagagatgaagtttgtcaagttttatggcaagaactacgacacagattcccttgctgacggtatcgttaaagaaattaaagagcacaagtaaacagtagttggaatgccactttgcaacgtcagccttgtttctgaatttctcccgagagttttgttaaatcaagcaaaaaccaaatggcacacgagatcatgtggcaatagctgatgacatttgaatctcgcggcggcttttatttcagcagattcgggtgcacatgttgcggttttgtgcacgtttttgtcacggcaaacttctgcgttattagcttgggacgctgttcattgctgaatgtaattttatttgcatagtttcataccagttcaatatgaaacctttttccccttctgctccctctgttttttgaatatttggtttccaataaaataagaacacatcaatttgtggagtttctaaatgaaaa

SEQ ID NO: 272 - DNA, 4701 bp, Zea Mays; identical to SEQ ID NO: 271

SEQ ID NO: 273 - DNA, 3253 bp, Zea Mays
cggaagcaaaagcaggccagcacaaaaccactcgatagaaaagcccccctcaaaacccacggcgccgccgcagccgcgttcacgaagcttggggaggcgagcaccccgatccggcgaggtgccgcgagcgaggcagcgatgagaggccgtgcgtcccatctccgcgcgctcctctcgcgagcgctctctccaagccttcctcctcctggtcgcgctctgcctcaggtaatcggcgtctttcccccatccttggcttccaccgagcgatggatctccgctcgcctttcttggagtgacgctgaggtgtcgtgactattttcgttcccgctgcaggtcactaggcccggtgcgtctccgttcggagctggattcgtggggcgcgcgcgcttcttctccatcgacgcctcggctgcgacgcagggcgggtcgaagccccctgcgccgccgccggcgggtactgcgggcggcgagggagggggtggtggtcagtctgggaaatctgaacaagcggacgccgggaaagccgtccgcggaggggtaagtgatggatccttatgcatgggcaaataaacgtgattgctctgaaatgttctatatggcacgaattagcagtgatctagagcccaatgaaacatgatggtttcttatttcctcaggacattccttatttctagactgtttaggtcaattatttatgcgagctaattcagaagcttttgctacttccttgcagccggtgtcttggctcagttttctactcctgcttgtgactggaggagggataatcgtgtactacgacaaagaaaagaagcgtcacattgaaggtagattactatggtgagttgtttgttatttgctgtcatgctgggactgcatttagtaatgcataggaatatctttcaatgttcatgttgtaccaaggcatattgaatggagtaaacatcaatatcagttagccacagaaactaaaaagtttatgttcagataatcaggaaacaaatctcgagatgttttaggtggatagtttacatgtgttcagtctagtaactaggtgttttcaaagttatgctcaagtggtagttcaacctagtgtatatctacactataccatgtctgctgtttcatattatcatataactatcgaactgtctaatcctgaatttgtatgctgagtccactcaaaatatctatctacccttctgaaatgttattgccatggctattggggatgttgctatggaaacaaaagtttctgtggctctgtgggtgtggtttcgacatgcactttttttgtcttcaagtgtcatgctgacggtcaactgttagatataaaatgaaattgaaattgtagtaggtgtgtagttttctttgtcttactaattcacaaagttaatagcttctgatttggcttcatgaatgttgcaccttgctacataatgcttctggaatgcattattcacacaatcaacacattgtcttatgttcattgttatgtccacttattatgagtgctgaactaggaattttaaagcttttatctattcttcaaggacctacttttcatgtgtagccttgtctgtctcagcgttttcatataaaaagcatctcctgcaggccccctttcaccgaaaaatgtatttgggggttgaggttttttcccttgctccagcagatcccccttcacatccctttttaatggttatcaccactgttttgtgccagcctccccaccccccaccccccacccccacccccccggttcatcttctggcaagcactgtgacatatactaaatacgccgctgtcccaaactgcttaatctgaagcgaacagtgcacccccaatgtacagctctattggcggagttgtattggcgatttggtagagaccctcttccataaaatctctgttgggcatgtacatctcttagactgaaaatccactttttatttttgtggaaaaaagatgtttatcatcaatgaaatcatcattaaagcaggagacaccttactgaatttgtgaccgctatgattgagcaagctaaggaccactctatgtttcatacgttccttggcaatcatcaattatttcttcattgctgtatgcaaaatcgggaaccattactcagccagttgcctaagcttgccctgccttccatactggttttccttttaacaataatttggccacaatctacactaatgtggaaaataggttaccattgatttgtgtgtattttcttttgtaaccactgcttgcattttcatactatcgttagcttttctgtaaatacatatgcatagcttttaagtacagttatacaaaagctgaactgaaaactaagtttgtgaaaaaaagtaaaggttcctgttcctctttccatgcttcttaatgatatcagtgaaaagccagaaaccattatagggcccgtagaaccattgtcagaacactttgtgcaaattgtatcttatattgtaacttgtatttttgttttaacaccattgcactatgacaaaatcattaccctctggttcagaaacagatcaccatttactatttagcgaaaattccaaagttttccctattttttcaaatggagatgtgtcctaaaaggagacttgaaaggatggaatatacccaaagatttagccttgaataggagtgcatggaaacagctctccatgtttaattctagccgaccccaacttacatgggataaaaggcttggtggtggtggtggtggtggtggtggagatgtgtgttttggaagtatttaattgaagtaggaaggcttgttctcatagctgtttatcttgtgtttttttctcttctgtcttatccagaattgaagaatagaacaagtgctgtgaagcctggacaatcagtaggcactgcagccattggcggtccattcaagcttttgaatcatgatggaaaacctgttactgaaaaggatttcttgggcaaatggacgctgctttattttggatttacacactgtcctgacatttgtccagatgaactccagaaaatggctgcagcgattgacaaaattagtaagtcaatttgagtcttttggtccttgggtacaagtatcttctctcaatatatcttcttgtattcatctggcactgttgtcttgcattatattgtcacttggaaactagaaggcaaataatagggtaaatgggcaagccaaaatgagatgtacatacaaggttatgtatttttgtttgactggacttggtgaaaa

SEQ ID NO: 274 - DNA, 350 bp, Zea Mays
aagaatctgactcggtgctagacgaatcgaacggaaggaagacgagaaggccccaaggtgagcgggggaacaaagaagaagatgaaggtccatgcggcggtgaagcgcctatgccggttctgcaaggtggtgaagcgccggggaatcgtcttcgccaaatgcacggccaacgccaagcacaagcagcgccagggcttctccaccatcgccgaagcagccgctgtctcgtgcgttcacctgcctccgcctccgccacagctttcgcagagtaagatgatcctccactctcatgtctggattgtccttgttcattgtattttcccctgttgttagcgagtaagcagttctag

SEQ ID NO: 275 - DNA, 17615 bp, Zea Mays
gacgaaacggtacggtgacggctcacctcgggggtctccatgtccatggacggccctgccacctcgccggcaagcgaggtgccgttccgcatcagcttctccggccacagcggccacctccgcctcgaccctaccccgcacacgcccagccccattccggacttcgtcctggtacgcttgcgttccccgcttccgccctaaatcactcctggcgttcgatgcaacctttaaaaccctaaacccaccgttgtggcaatgacgaccacagccgccggcatacccggccgagagcccgagcagcgtgaaggagtacctcgagaggaactacctcgaccccgagctgcacctccccaccgcggccgatagcgggagggtgtgggatgtcgactggtttgccctggccaggccgccgctggagccctccgccccccgcaccatgctcgcgcccgtctgggtgccgcctttccggcgcgggcaggagaagttgcaatccgcggcagagtcgcgagtgtgggaccctgagtccgtgcaaatggagatggtcgacgtgttcgattcggggaccggggggatagcgccccggatgcctggtccggcgaaggacttcgtcagggggagcatcaacaacagaccttttcgtccaggcggtctgcaggatgacgccgctgaggcggctgcgctggaaaaggcgttcccagagggtgcaaggactggtgattgggtgcgtgagctcatgagcggtggcccggcgcaggttgcgcctccagggttccgtaagggattggagctgggccagttgaaggtttgacccttacttgtgtctcttccactatataaccacaatcaccgatgtggtcatgtggatgtgccaaactgtgcagcggctacttttcttgtaggggtatgaaagccactggaagtgtttccgggatggagaacttgtagaggagcaacctgcatcatcatcgaatgacacaatggtaatcagaacacatattttgcatttgaacaatccacatctgtgcttactttgccattgtagagttgtagccttgattatcccattgttctgcaggagaagtactctgtgcagtttgatgatcttttcaagatagcgtgggaggaagatactgccaacaagttgttgaaggacggtgttgttcaacaatctgctgaaggtgaaggaatcaatggtactttattgttctcacacatcatatttttaagttacatgagtacactgtcttggcaaattgtaatagctaaaaggtaatgggacattgtaaccactgttgctactaggacattagcattcagttcatttaccaaagcctggtttcttgttaagattttcatttttcattggcagaaattggcgaacaaaaagttgatgcattgcaggatgagttcgagagtataacaacgctagatgacgagaaacaggaagttgatgtcataagaaatgttcctgaaactcaaacagacttggatcagatgttatcttctgaagtacaggatacaggcagggaaccaggtgcatcaggtgataagaagccaacacaagatggcatggtaagcactctttatgccttttcttctatctcactttctatgctgtgcttcttgttctgtaagcttcaggggtagatattgttgcagaaatgataaatgtggtttggtctcacaattctcgatagatcatggatggaccaataatgccaatgtacctctatttcatctataggtttgggcacttgttggtggggacgaggacatagtgactaacttctccaaactcgttccagatatggcaatcgagtttccatttgaattggataagttccagaaggaggtaaagtactcatatgcatccttttctgtttcaatgtattctccatattgatcagagtgtctattatactgcatcatccaagtgcatgcactgttttttttacttggacttttaggcaaattcacattacatgcttctaattgtagtacttcatctatgtttggcagccttagcctgcaattttactttccggtatacactcggtcgcagcttgatttcgtattaggacataccgacatagatactttcatactatacattcagcctgcgatcatctaaacgattttacttctattgccttgcaataccacattagatattttcttaaaacagcacaaggttgcatatctctgtgagaaatttaaaagctagtccagtctagggttgtctttcctggaatacaagattacggataaccaatttaaatgaaaagaaacatctagtgaacatatataccctttcttctatttcctgtgggaactatttgttacaaggtgtcttagatggtaccactacctatctgtttttgaacttagaacaatgttttcaagtcgtccgattaattgtgattagtcgcgattaatcgtccaagtcggtttggaccaatcacgattaatcgcccaagtcatccgactaatcgtgattaatcgtgattaatcggttagccagaatgatcagcaagtcgtccgacttgaaaacgatgcttagaaaactatgtttaaattgcttcgtatagttgctaatctatatttcttttgtctacaaagcacaggctatatattatctcgagaagggtgaatcagtctttgttgcagcccatacttcagctggaaagacggttgttgctgagtatgcattcgcattagcaacgaaagtatgatttcatttgctctttcttactttttgggtaattttgctcgttttaaactgcttagcatcttccgcacttaatagcttctaaacccttgcatttagcccccagcagcccagcttattactttttttagttgccttgagaattttccagttcttaatttctgataagattcatgcttgcttttctcagtagattgatctttagattacatgccccagtgcactatctcaaattcctcaccgtaatagttgatttaaacccccactgtaataaaaaatgctagcattgatcttattatgacagataattttgttatgcagcattgcactaggtctgtctatactgctcctattaaaactatcagcaaccagaaatacagagatttttctgggaagtttgatgtgggacttctgacaggagatgttagcatcaggccagaggcaacttgcttaattatgactactgagatattgcgttcaatgctctacagaggcgcagacattatacgtgatattgaatgggtaggctatcacttatgatttgttcactgtgttttactctgtgccttcaagtttcacttttataatcttgtaaacggatcatgagttgctgatatgtgtttaattgtacactcaggtaatctttgatgaagtgcattatgtaaatgatgctgaaagaggtgtagtctgggaggaggtcattataatgctcccgaagcacattaacattgttcttctttcggcaacggtactgatttagtgtaaacagcacttttactcactatgttcactatcaaccaaacattcatgtactggctgttgaaacagttgctcagtaatagctaggcacaatatgacatactaagggcacccacaaggccaacaacagtatagtaatctgccctctataatagcagtagcaattcaccttatctacagacaggataaaagaaaaaaagggcagacccagtgccaaagtctcccacatgagtgggacagtctgaggaagggataaaccgatacaagcctcccccccataaatgtggtgagtctgttttgaacctgtgacttggtgacttagtgagacaactctcaccactgcaccaggcctacccttctaatctacagacacgataaaataacacgtccaataatgaatgatctatctattggcacaaactacaagaaaaaatctcgatctgcgtgggtaagacaacccctgggtatcacattaagaagacctcacataggccgagaaaaatcctgaaaccttgctccacccatacacagcagcaccatagcccatatgggaacgaccacgaccggggctaggccttagacccgtgctttggcatgagccaaaaaccacagcctgaaattcgctaccacagggagttgaatttaggacttgtggagtgctactcagaccacctaaccaacttaggtagaggccttttcgtcacaaggtgcaagaaataataatgcccacgggtaagaatgatagttcgtaggatggtttctatagtggcatggcatggaaactagttagtggtgtctgggttagggttgtcctaatgccatttgcagttgcttttgatcttttgaaatagttggcacataactctgatcttaggagaattttgtggttgtccaagttttatagcatgcaattatggtcttgtattgctattaccctgtttcttgatatgcatgcaataaagtgacatgtccactgatgttaattgtgcaacttttggctggcagtattcatccacaaatagtacttcgtgaaaacaatatagttgaaaactagtcctctaaatatgatgttatgtgataatctaatatcaaattaccatttgaatatattggcattgcaataataaaatattctttttgtatatttttttatcgaactctcaagagaattgcatatcatttcgttaagagaaaagagagtacacaaagaagggcaagcttggtgcagtggtgagaaagtctcattgagccaccaggtcacagtttcgaagcaacttctttgcatttgtgagagaaaggcttgcctcagtttattccttccctagacgtcactcatgggggagcctctggcaccgggtctaccttttttagaagagtacacaaagggagggcattcccctattggttcaaagaacaaaatgacacctgttctttttctacaaatatctaaagttcgaaaacattgtattgtttcacttattcatttttttgcagttgaaccctatttgtttcttttcaggtcccaaatactgttgaatttgctgactggattggtcggacaaagcagaagaaaattcgtgtcacatcgtaagtgcacttagtataaattttaagctaatcaatcacaccccaggcccttgaactatattgtcagttggtttagtcactagtcactacttcactaggctggttagagtcatccaattagctcttttgttcatgctagtgagcggtatatggaatctaccttgctagaaaagtactgcttatatcatgtgagtgccattttacaaaattataaatttcagttaattattttctatctcaggatatgagggtggctgtagccatcaaatacgcatttctagattatgaagcattcaactactcaattgtaagaggcaaattattggttggtctgttattaactgctggtaggatatgaatgcatataggcttctgggcttgaaaaatcaatgtatttgcttggattacaggatatgagaacctgacaagtattttgagtatgtagaatgtagatacatcatacatgctgtccaaggacagctgttgtcattttggacagctgttgttccaaggacaactatattctatctaatacaatttatttctctgttctgtgattgtaattattcctcccataacaaaaggcaaagcgattccatggtattatgataaattagtttgtattcagattatcagtgatgcagcctaacacccacctttatagcaaatcacatatactggatacttctagcttattcgtaattgaactgtgcttcttctcattgctagcgttgctataagtccatatgaaaatcctgaatctcatactttatgtgtaaaaaatcaactagcaatgccgttaaaataatactccaaagtagtgatacctctttcctggcaatgccgttaaaaaaaccagcaggccaggattggccacgtcgccgtctgcaaaacgagctctcggagccagtgcagcccaattcactctttatctctgccccactaggtaaagcggcagtttttctgccacgctagtcacctcctgtcaggctgtcacgtgaccagagcaggaaagctatggacgcgtgatcggagggtaaacgctgaggctgacctcggcgccgagatccgtgacgccgaggttgctgccatgcaggcgccgtctcagtgtgcggatctgagacctcgttgccgagctgatggtctattttctgaaatgaaattgaaaagggtgtatttgtgaaaaacttttgcaaaaagggctaaaataaaaaaacgggactgttgctgcccaaaatgacaagaagctgttcagcagcagctgctgcagctcactctcacagattactatgtattactgcaaagtagctcaagcgtggaggtagatggtttttcttgggggtggtgggtgttggagaatgtggtgattttacatcgttttgcatcttggtagttattttaagaagcatagtgttcgaactacacattagttaggcaggggggggggtttggccgttggcgggtgttggtgaatgtgggggttttacattgatttgcatcttggtggtagttatccttcaaatttaagatgccaatcttgcttgattagacataatggtcacaccactttaaatattagttaaaaatctgtacaaatctgaatggagcaactgaaaggtctatactttaataaaacaaactcagctgaggggcaaaaattaacacactcagtttaaagggacctgcttatacatatttgggaagaggcatggaaaggccaaagttgacaggggaagaggcagtaaaaggagacttgaaaggatgggatacacccaaagattttagccttgaataagagtgcatggaaaacagctatccatgtgcctgatctctgacttgtggtttgtgttgggtttcaactctgcctaccccaacttgcttgggactaaaagactttgttgttgctgcttatacatatatggataatatatggggccagatcaacaatactagaatttagggggtttggttgcaggcttaccatttaagtggataatagttttgatttgccttaatgcacttttgaatatacttggatacatggactataattttgatcacagtttggtcatcatgtgttcaccaggaccaacaaaaggcctgttccacttgagcattgcctgttctactctggagaagtgtacaaaatatgtgagagggatatgtttcttgctcaaggatttaaagaagcaaaagatgctttcaaaaagaaaaatttgaataagtttggagtgaaacctggttcaaagtcaggaacccctgcagtacgtgctggaactcaaggcaaaaatccagatacatccaacaaggggagagatcaaaagtacccaaagcaccgcaattccaattcaggagtagccacagttcaacagagctcctcagggccaaagagatttgaatctttattttggatgccacttgtgaataaccttctgaagaaatcccttgtgcctgtatgtgagataatagcttttgtgatatctccatcatacaattataaattctgtcggttctttactttttcatcatttacactgaatttgtttgatccttaatttgaaatctgaagccagtctcaatatgttataaaatgacaggtagttagtctcaacattttgggaatagacttgtctctttttatcatgaccatgtcatttcacatttgacattcttttttgatcatttagatggtcctttaacaggtggtgattttttgtttctcaaagaatcgctgtgataaatcggcagatagtatgtttggcactgatctcaccagtagttcagagaaaagtgaaatacgtgtcttctgtgacaaggcattttcacgtcttaaaggatctgataggaaccttccacaggtgatcttgtgacactgcaaaatttagtcctctagccctcaccccgtaaacctatgcttctgttaatcagttcaatgctttaaactttgacctctttgataggttgtaggaatacaaagccttctgcgaagaggaattggagtacaccacgctgggcttctccctattgtgaaggaagttgttgagatgctgttttgccgtggtgtaatcaaggttatgctttgaacgtctggtatatgtacggtatttaatcacatgatagatgctgctttacctagtactaagcttggcggaagaatcgtattgttgttttgtttgccttagattgtaaatgctgaccagtgaccactaacttagcccatcctggccaaagttattgcagtcatgtagactataactgtagcaacctttaccgtacacagttctttaacttgaatggacaatccaacagaaaattgatagtcctaataacatcgcactgctcctgaaaagctattttttccaatgctccagcggcaaatatagcatgttctggtacatttgtcttataatttacaaaatggtgagcttctgacttcttgaactcattgtaggtactgttttccactgagacatttgcaatgggtgtcaatgcaccggcaagaacggtgagattctattttttatttagggtttcaatgctttggcatcttgaacaaatcactctagtatctactatctaattctatgttttgtggcacctcttgcattctacttcctacatattaattttacctgtgttcctgcaaccatgggaacaaaatttatttcaaattttcctgtggatgaaaccgtctcttctacattcattgtgttttcaaggaagctgctacctgggttaatcatttgtatttagcaatctagttttctcgaacatgcagaagagctgcatatcattatatcaaaaagaaaaatgcgacaagaactcaaacacccacaagaaccgacacataccccacactgctggttcctagaaaaggcaatctatttttctatgttggcactatgaattgcaggcgggtatgctgtgggaccaatttttatgtactagagcatctccacgggttttgtaaaacaactcccaattttaatattttagcaaaaagggaaaaaagtgcactccaacagtttggtaaaagagctctttaaaaataaaaagatgccaaatatcctttccaacttttaagtttctgcagctgagaggaactccgtatccgctccccgttcggcatttttattgggagagattggagtaaatcggacacatgcgttaattgtggaaataaacggttcaagatgagaaagcgtaagagacagaaactattaaaaatgattaattaataatagtttggggttcccaatgcaaaatcatttaggaagctattattggaaactgttggagaaggacaaaatttaagtgtaggaaggagagattgtgtgctgctgtgctcatggcctaaccatccttgtaatttgggctgacctcgtggtcacccctttttatttcttcttaatgcaatgacttgcagctctcctgcggtgttctaaaaaaatagatgggattggatgattgattgtattgcattgagcatggtttaaaaggcggctaggcggaactaggcgcccagccaccgcctgaccgcctagaggcgacttaggcgggcgcctaggcgacgccttagtagctgttacaaacagctgttacaaaataccaagcaaccaaacagctgttacagctcataaactagaaatcatcacaaattgacaatagcacaatagtggatctgaaatagccacaaagtagtttctaaaggaacaatagcaagtcacaaaatttaaaacagcacaataccaaatctgaaatagctacatagatagtttgtaatggcataattaatagtaactagctgcagttagtaatgcagcaaatatgctaatgcaatctagcaatagctactctccccgtctcccgtcgctcaaaaatcatcatcaaactctcctgggatattgggtgcctccccttcttcaccatcattgccaccattagattcatcttcacaatctgtgatttctgcatcgtcatgtggaacatcttcttcatcttcatcttcctcttcagcctgcagcaacataatttcttcttgaatacatattatgggcccttcttggtaagtttcggccacgaagtgcttgtgatgctccaatggcattatccacaaggtcccatgtaaggtcacactcacacccacgcccaccttcagggactacatgcaaagaatcagcccactcattgtcccagttgaagtcctcatgaaccaatggatcaaagtttttccccttcttctggcgtagtttttggaacctagctttcatctttctgttgtaggaaatgaagacaatagaattcaacctcttatgcaacaatcggtttcttttctttgtatggatctacaaaataagaaaagagaaaacacttggtcatttaatcctgaaatattggatacaaaagtagccaagtaggtggatgaggacttgaggaggcacacataataacttacaaattcaaaggtactccatatgcccctgccaaatgttgctttaacctctttatccctccactaacaacctgaccacatagggtgcattccaccttatctttattttgaagatctggccaaaatccatacttccaccctggatcagtagacttccgtggcttccgggtaggatcgctcttcgggtcgtactcaccagccacagaagatggagcctcatttcgagaagacattatgttgtcggcttgtcgctagtcgatgcagtcgctgcacagtctaaaaacaggggaagcaggggatgagaaaacaggggaagcaggggaggaggggatgagaaacgcggggagtaggacttaccagcaggcagcagctagcacagcagtctcgagcgtgcgcggccagggagcagcagccgtgcccagcagcagccgcgcgcagggagccgcgcgcagggagcaaagggagccgcgcgcagggagagagcgcgcacaggggattgagcgcgcgcaggggagagtagccgcgcgcccagagcagcagccgcgagcgcgcgcagggagagggagagcgcgcgagagagaccgcgcgcagggagatttgccgcgcgcagagaaatttgccgcacgcagggcgctgaaatttgccgcactgaggggagagagcgcgcgcacagggaagcccaaaacgcgcctaaagcccagtgcaaaccctaacccaatgcaaaccctaggctaaggcgtcgcccagagggagaaaggcgtcgccgagacgcctaccgcgcctaggcagacgccatactcaatgtcacctgggcggcgcggacgcctagccaaattcgtcgcctggatgcctaggcgtcgcctaggcgacgccttttaaacaatggcattgagccctcgggccggtatatataggagtacaagacttgggaggcaagagtcctccccggatacatatggcagtcctaggtacacacgattcctagagatatacgatatccaatactaccaattgtactctatcattaagattgctatttctactgttaacttggcaggtctattagtttagcaagtagattataccaaactcctggagatgctcttatcttaccaacatattctgttgtttgctgttcttgcacttgatgcattgcccagtgtttctttgttggaaagataaatcattttaacatagatgcttgagatgacagatgcaggggcgacgccagggagggggcagaggggggcaatgtccccccccccccccaaaaaaaaaaaacctggctcctggcttcgcccctggacagatgcatgccttaatttccttgtttctttttgcacatttggactgagataactgtaactgtgcataggtcgcacttgctttttccatgcccttttaaactcaggattatgaagctagctctgagcctatctcagttttgacccaacaggttgtgtttgattctttaagaaagtttgatggaaaagaacaccggaaattgcttccaggggaatatatacaaatggctgggcgagctggtcggagaggacttgataacattggtactgtgatcattatgtgtcgtgatgaaattcctgaagaaagcgatttgaaaaatttgatcgttggaaaaccaactcgtttggaatctcaatttcgattaacatacaccatgatactacatcttctgcgtgtggaggaactgaaggtataccattatgtttccctggttagatatgtttatattttcacttctcaacttcatattttaatgtggaactgtacctgggtctgcctacacatttgaaaccttggagaacgaatttttttgacaagacatttatgttgctcctgcagcagtgctcatatcatcctctgttctattaaaaatactttgtctgtgcgtgtgcatttctgcaataatgacatcccctatttattcagcatgaattatagttgtgtaataatatttatagcaatactagtatactactactgtccttgtacagttttgctctatatgataacccattgtgctcttgggatgccacatggtagctgagcaccaggtgaagccttatcagactactgtgccactaccctcaaggcattaactcggctggtaggggaaagaccgctcccactgtattatattaagaagaagctcaattggagccctgaccgagaaatgtcacgaaagttggtcccccctgcaacatgagggtctgccccctatgggctagatctttactcgtgctttgagcctcccagcccctacacgaggatcttagttccaaggctgtcattgattgactatctgctcaatactgtacattccactgtttttatgtttactgttataattatgggtgacaatgtgctctcaattttacactataaaatttaaggatccaatcagattaggatcgagctctattcctgttcatttttgaactaaaattatttaagggatcaaacaaattatgaagaaatatttggatcgcgatccattaccacccctagttataattggcactgatcttttatgggcaaaggatgaaaacacaatcaattttactttcagttgaaatgtactcattacacaacattgttaattaaatttagatcaaaataagaacttgtcactctttagtagattagcataatacaagctgactattctagatgggcatggtcacacctttttatgcataagtaagttttatgagcatttgcactccaatagttagcttttggagatcaagttttcaaattcacaatctatcagcatttttaaagccacaaagtggaataagcttttccaaaaatcgaagctcaaagaaaacaggcccttagtcatgctcatgcataagtactttcatctcaagtgcacaatgtgtcagttgtaactagatactttacctaacttccccatttttatttctgaaaccgcttgaagagtacattgtgtacacccttaatcatgcatagggaaagtaatatactgtaacattttttttcataggtcgaggacatgctcaagagaagttttgctgaattccacgcacaaaagaatttgcctgagaaggaaaagcttcttctgcaaatgcttcgtcaacctacaaggacaatagagtgagcacaaacactaactgatttttacctgattgtttcaatgggtaccaacacttgcatagaatataaaactcaaagaagtaaagtttcatggaactatcactgctgctttagcacaataaagtgacaagcaaaaatcaaaatactgataatggaaaacaccatttcttcctagaatctgacctttgtaaacattaacacaagtaaactatctagtaatcttgtagtattattttatagcgcagtttaggagtagtcatgattgtttggttacaagattgcagaaatgtggatactgaacctagataggcttagttagaactgtgcattcattgcacatgtgaagactagaaatgtgggcatttttccgtgcataaagttgcaacaaagtttatttcataatttctttgtcgtacatttgtcaatgttttagggcctgtttggatgcataggactaattgctactgggctagtgtttagccttagcccatccaaacagggggctaatcggtgggctaattttttcgccaagcgtccaactaattgttagtcaagtagctggccaaccctaactaatttgcgctaatttttatccctagctaatccaaacaggcccttgcaagcattcattgtacatttcaagtactgacaaagtttagtatccaatctctatatgcactaatcttagtttttttaatctctttgccttgtattatgtattcttcgattatcaggtgcataaaaggagagccttctattgaggaatactacgagatgactttagatgctgaggcacacagggaatacataacagaagcaattatgcagctgcctaattctcaacagtttcttacgcctgggagattggtggttgttaaatctgattctgtatgtattcatcatatttggttctctttacacacgtctgcagtttttttgcgattatttttatttatgttctattactctactaaccaccattcaactgctataaaactcactaaaaactgtcttccactttgggtctttattagcaagcatacaaaagtagtgcacacagaatatgggaaattagaacaaacaaaaacaatttatgttggaaaaggacctattgataaacaagcaccgaatatctgagaccaagctccaaagagaattactaaaaatcatgtgagttccatgtacaccatgatattagcttggtcttctcgagctttaaatcagcttgatcttatcatattcctggttcaagcggaactaactccataagatctcaacttgtgcttactgctttagagcttctttctgataactaaaattgaccaggaaatttaagtaagctactttaggaagttccattatcttgttttgcaggccaccattatattattggcaccataaccatatgtacaaaagcatgactgttttgaaattatgatgctctactactgtctaagggttactgtgaatgtgcgatagttacatttttccacatttaaacgctgtgctatttgaacatattggcaggatgatgatcacttgcttggtgttatactgaaaaatccatctgcattgctaaagaaatatgttgttctggtattgactggtgattgcagttcatctgcactagcccctgagttcaataaaaatgaaaagggtcctgtggattttcaaggaggacaatttattgtcctgaaaggaaaacgtggcatggacgatgaatatttctcttctgttagttcacgaaaagcttcaggtgtaatcaatatcaatctaccatacaagggggatgcatctggaatgggctttgaagtaagagcaattgagaataaagaaatcattagtatatgcagcagcaaaataaagattgatcaagtcagacttcttgaggagcctaacaaaactgcatactctagaactgtccaacagcttataaaggagcaaccagatggaaccaagtatcctcctgctttagatgcaataaaaggtacaaattttctgcatgtcttgactatcttgtgcaattatatgttctgtgtctaggaaattcttagtttatagcctgtgaagttcactaactttctgacaaagtatatactgccctagttagagggaaggatggtagtaatataatcatatatgttttatttacttctttttttttggactctgatcattgttgtgcactggtgcgtcatttaggccctactcttgacttctctagttgattcatatactttatatatagctgtttaatgtgtccacacgatgcaatgcagatctaaaaatgaaagacatgtatcttgttgaaagttaccgtgcatatcacatactactgcaaaaaatgtctgaaaacaagtgccatggttgtataaaactgaaggagcatatatcattgatgagggagcaaaagatgtacaaggatcagttgaatgaattgaaattccaaatgtccgacgaggcacttcaacaaatgccagagtttcaaggcagagtaagattccttcatgcacagttttcctcgtcttgtgtcctattgtgtgcctgaagagaaaaaaaagttaatgtattatggtcattgtctctgcaacatggaaaaataataacaatattgtcatttctttattttttttgattgagtatacatgggagatctttctggttccagctctatcgcagtactgtaccaggagaacagtttggacatggattctgattctgaatattgggcttaatatgttaatgttgtatccacgcaatccatgaaagatcaggaagctgcacatttgtattgttgttgttaattcattttctttatttatttaacatggaatggttatagggctattatcagcattttcaagactgaaattttattccgtgaaccacatctgacttcattcctgtaatttgaagtactttgctaacaccttaatcttttgcagattgatgtactaaaggtaatccactacattgattctgatctagttgtgcaacttaagggtcgggtagcatgtgaaatgaactccggtgaggagttaatatcaacagaatgtctgtttgaaaatcaattggatgacctagaacccgaagaagctgtggctattatgtctgcattcgtcttccaacaacgcaatgcttcagaaccatctcttactccaaaactggctgaagcgaagaagaggttagacaaatttttttttgctcccataatttgactcgtgctatggttcttttgataacctcaattatattttctgagaagccacgtctcaaacacgttttgctcgtgtgtttttctatatgtattattaggctctatgatacagccataaaattagggaagctccaatccgagttcaaggtgcctgtggaccctgaagagtatgcacgtgataatctcaagtttggccttgttgaggtcgtctacgagtgggcaaaggtatactcgtcttcaggagaattcgtctccaagatatatgcaggctgcaggattataacgctgtcacttgttatattatatcaatgcaggggacgcctttcgcagacatatgcgagctgactgatgtatccgaagggatcattgtaagaacaatcgtccgtctggacgaaacatgtagggaattcaggaatgcagcttccatcatggggaactctgcgctgttcaagaagatggaggtcgcgtctaacgctattaagcgtgacattgtgtttgcagcaagtttgtatgtcacaggaatctgatgcatgtaacctcgtagtctcccttgcttcttttgttagagaaatcgttgtgctggtggaatgctactaacctaaccttagctagaacaattgttgtggtatttttttttccagttctggattattgcttttgctagttttgcgaagttttctgaagcggcgaccagcagagtaaaggaaaatcgaaagcgggtgggattctcg

SEQ ID NO: 276 - DNA, 5345 bp, Zea Mays
atggcgaacccccgcgtcttcttcgacatgaccatcggcggtgcctcggccggccggatcgtgatggagttgtacgccaacgaggtgcccaagaccgtggagaacttccgcgcgctgtgcatgagctggaggcgccctgcacgacgtcttctaggtcagacggtcatgggcgatggtgccgacgaagaggaagcacaaaacatgtgccaccgaaccctccccaaaccctatcttcggatctcgatggcgaacccctgcgtcttcttcgacatgaccatcggcggtgccccggccggccgaatcatgatggagctgtacgccaacgaggtgcctaagactgtggagaacttctgcgcgctgtgcacgagctggaggcgccctgcacgacgtgcttccaggtcggtggtcatgggcgattgtgccgacgaagaggaagcgcacaacaggtgtcgtcgtggtcgcgaccgtcgtcaagtggaaggtgggcgacctcatgcttaccaagatgaagagcttcccggtctagccggctatggtaagtgtgtcgtctcaacagcttctccttctctacccgctgatctttggcctccctgtgtcctgttcagcctggggtccaaggattctgggtctaggcgggggtttcccacttaggatttggtggcggccttggaagaccggtggaagactggtgagctttaggtagtaggggctacttctactatggatgatttttaaatctccattttctatctcatgatatgttctacaatgatacaagacattattctgccactgatgcagcattttctatctcatgatacgttctatctcatatctcagtgatgcagcatggtattctttgcagaaatctcatctttgtataaatcatacgtgtaggtactttggtttgtcaacaactcgagtaacgaacaagtcaacaaatggagaagggtgtgacatgaagtaattatttactttagaatcccttcagtgaccatttcttagataattctttttcattgcgatgcgtgtcaccctaacagatatgtggcttgttgtagagaaatcacaattccccaacataacacctgaattcatcattgaatcttcattccacatctgtaggaacaatttcacagaaagcaaacaaagacaacgacgacgatttcagccctcgaggatcttccacgcctggtttgaattcctctacttttgtggaacatctattatggttaacattatgtgtgttgtgggcagaaactttgtgcatttatctctctgtgcattcaatccaagagatacttcttgcttatttgacctcaatcatttttgtagcaaggacatgaggagcttgatggagccagcttacgggaacatgaagaattcacaaaggtgaaaaatatcacaaaggttgaactggggagatatgagatagatacaccatacatggtatttctctccttttccactagattatattgactacccaaaactatttttctgtggattttgcctcagcttcatgaagcgcaaagaattagcttcagaggcacatggtgagctatacttgtttgtgctttataccttgcctatttgttagatacatgctactaacatgagattaaaactggtttatttagctcgattctatttagttttaacctaggtgctagactggacactcagagacaatgaaggagaaactagagtatcaagacagtaactagaaattctagatggtactgtattgagacggcaaacatccatatactgaaataaacaactaaccataagaaattagtcataaagtacactgttggcatgtcttgctattaatcaatactcaataattaaccgtacagtacttttaatatttgagcgactatccaactacacatgacaaggctgcacacacaaagacaccctaaaacagcggatggtttccttagtgattgtgagacaggttttgggtagcatgtagggctagtaatggatcacgatccaaatatttttttacaatttgttagggccctaaactaattttagttcaaaaatgaatagaaatagagtccattcttgtaactttatagaaacaactttatagtgatagttttttacgtggtttggttgattgcaagactaataagtatcaattatttgatactgaatatttgtgttttgtctcctgcagataagtaacttatgctttgattgtgttacggtagttaactaggctttattcacatatctctactattctatatagtcaaagcaaggtggcagaaggacccaatgttgatattggtaaatcatgcgcaaatgggtgtgctgaaatgatggagaacaatagggaacatagaattgctcttgttgctgctggattagctgctggaatcgcttcaggtattttaattaattatttattccattcgtaatatggactcaatgaaccgaaaatgaaaggggtgtatttctagttttgtttcagcttgctaagatattggtcgtttttatcgaaaaattgcacttctgtttaggaagtagaaacattaaatgttttaagaataataaatatttgcttaaattcctttttataaccttcgtacaactgagtttcacatggatgtttaattaatttactactttaagaagcaatcccagatccacatctaattgtgcctccctgtattctgtatgatctatggagatcatgttgtatctttatggatccacagcagctcaacatgtggctaaaaatcagttgcatcagaaatattaagcaaattagacatgcaggcctatcaacttatttctggtataaagaaccgagatccttaaaaaagaagaaaatattttacttttgatgcagcttgctggactggaccccgttgtgttcttccgatgatcaatcagtcaatcacaaattcaaaccatacaaatcaagtatgtttttattttatattacggtgaaatgatactagaatttcactgacatgttacacaatttttctcagctcaatatccaacgtgcttctagaagtgtgttcaaggggtggagtgaggagaagatatattttgctcccacatacaagtactcttgcaactcatattcttatgctggagagactgccacatcaaagaaaaagaggagaaccccggcttggtatgtactacaatgtttgagacagtttcagagagttcagatctcattctcatatgttaacactcgtcagtggctatgaagtatcctaaagtgcacaaacctctttgcaacccgaaaaccttgtgtttcccctttctgtaccacaagaaccatcttttgagagagttaaatcagatttggacagcaaggtaagttgtaagcgtggggaaacacaaaagaggaatcattctcatgtgcaataaataaacaaatcaagatgattcacatattctgaattcaggaatcacacttcccaaaccatgaatacataatactattaatgacctgtttgttgcaaaatgttcaggtgtgatagaatactatggcatggagatggtattgcacagttgtcctacttccggggggaatctcaattctcttaccatcgtcctgtttgtgggacatttactgttgaggttaaaaggctagatggccgatcaaagcggcgcccatcaaacaccaacattataatcgatgcagttgttaccgacaagagacaagcataactaaggcacttatgtgtcttcagtcttcttgatattgcattaatatctgcaggcactacagcagtctatgggtccttaagaaaagcacaaaacactgcactagaccagtgaaccatacttgcatagctatggcccatggctaactactattattgttatgacaccgtcggtgctggggcggggcccaaatcaccgattaaagcctaggtttttgtgtgacttgggaacacaatacctcggaaccttcgtaaggacgctaagttatgtgttcctcaaggaaatttcctgtgaccatagaaatatgattaaagatcatatgcttattattataatgttgttattgtacatcatatagtcgcgtacagtttcgaaaggaacattagtcattagtttatattgtatacttgtaaaacttcctcacagggttgttttggttttcatttctacttctttcatttgtgtaatttccaaagttcaacagagtagccaaaacatgttcgctttctttgttgtactgtacaaagtttgtattttgacctttgttggggtcaagttttgaatttgtgtaacaaccttactggaaggagtttaattgtacaatatactacctccctccttatttatttaacgccaaataatgtaaaattgaactgaaaaatgtcaaataaaaaaatggagggagtatcatttatcccttgtcttgattgttaaatggattaagtactgtgaatggacaaagaactgataatttatctgtgtgtatatcgcttagtttccaaacacttgagcaaataatcgagcaaatcagagtagatggcggactcgacagataacaaaggatcgtagcgtcctctttctcagagcaaaattaatatcagaggtttgactataaataagattaagctatacaatagttgacctttatttatctacaaaaaagttattattattattatatattattatattcatgaatgacattatagcaatcatggctatagttaactttgagctttgcacacatagtgtttccatcaacagactggttagtgtttgggtgtagtctctttatggtgtgcatatgctttgcacagtctctgactgtgtttttgtgattagtcatcagggactatgatgagtgttttgttttcagggtgtggtctgcagatgacagacaacaactcatggatagtttagtattggtggtctctatttggtgtccctgactaacatgagtgtttttgttgtaggtgatctagatggatgaaattgtcgacaaggccattagcatcaaaaaagattacctcaaagcatctcatgtatatccgcaaggagaagctgcactcagggaaggcattgagtgcaatagaggtgaaggaactgcgcgaagcccttgaagcgattgctgaaggtttggaccaagattcactcttgtgccagagtttggcgtagtcctcgattataaactgtgtactatgttaatgtaatgacatagtttgtatgatacagatcgtagtgatgttgtttgaagctgtttgtatgaactgtttcctactatcttgtatgaattatgatgtctgatgtagtttgtatgaactatgtcatattatgttgaatgaagctattgcatgccctta

SEQ ID NO: 277 - DNA, 3787 bp, Zea Mays
atggcgaacccccgcgtcttcttcgacatgaccatcggcggtgcctcggccggccggatcgtgatggagttgtacgccaacgaggtgcccaagaccgtggagaacttccgcgcgctgtgcatgagctggaggcgccctgcacgacgtcttctaggtcagacggtcatgggcgatggtgccgacgaagaggaagcacaaaacatgtgccaccgaaccctccccaaaccctatcttcggatctcgatggcgaacccctgcgtcttcttcgacatgaccatcggcggtgccccggccggccgaatcatgatggagctgtacgccaacgaggtgcctaagactgtggagaacttctgcgcgctgtgcacgagctggaggcgccctgcacgacgtgcttccaggtcggtggtcatgggcgattgtgccgacgaagaggaagcgcacaacaggtgtcgtcgtggtcgcgaccgtcgtcaagtggaaggtgggcgacctcatgcttaccaagatgaagagcttcccggtctagccggctatggtaagtgtgtcgtctcaacagcttctccttctctacccgctgatctttggcctccctgtgtcctgttcagcctggggtccaaggattctgggtctaggcgggggtttcccacttaggatttggtggcggccttggaagaccggtggaagactggtgagctttaggtagtaggggctacttctactatggatgatttttaaatctccattttctatctcatgatatgttctacaatgatacaagacattattctgccactgatgcagcattttctatctcatgatacgttctatctcatatctcagtgatgcagcatggtattctttgcagaaatctcatctttgtataaatcatacgtgtaggtactttggtttgtcaacaactcgagtaacgaacaagtcaacaaatggagaagggtgtgacatgaagtaattatttactttagaatcccttcagtgaccatttcttagataattctttttcattgcgatgcgtgtcaccctaacagatatgtggcttgttgtagagaaatcacaattccccaacataacacctgaattcatcattgaatcttcattccacatctgtaggaacaatttcacagaaagcaaacaaagacaacgacgacgatttcagccctcgaggatcttccacgcctggtttgaattcctctacttttgtggaacatctattatggttaacattatgtgtgttgtgggcagaaactttgtgcatttatctctctgtgcattcaatccaagagatacttcttgcttatttgacctcaatcatttttgtagcaaggacatgaggagcttgatggagccagcttacgggaacatgaagaattcacaaaggtgaaaaatatcacaaaggttgaactggggagatatgagatagatacaccatacatggtatttctctccttttccactagattatattgactacccaaaactatttttctgtggattttgcctcagcttcatgaagcgcaaagaattagcttcagaggcacatggtgagctatacttgtttgtgctttataccttgcctatttgttagatacatgctactaacatgagattaaaactggtttatttagctcgattctatttagttttaacctaggtgctagactggacactcagagacaatgaaggagaaactagagtatcaagacagtaactagaaattctagatggtactgtattgagacggcaaacatccatatactgaaataaacaactaaccataagaaattagtcataaagtacactgttggcatgtcttgctattaatcaatactcaataattaaccgtacagtacttttaatatttgagcgactatccaactacacatgacaaggctgcacacacaaagacaccctaaaacagcggatggtttccttagtgattgtgagacaggttttgggtagcatgtagggctagtaatggatcacgatccaaatatttttttacaatttgttagggccctaaactaattttagttcaaaaatgaatagaaatagagtccattcttgtaactttatagaaacaactttatagtgatagttttttacgtggtttggttgattgcaagactaataagtatcaattatttgatactgaatatttgtgttttgtctcctgcagataagtaacttatgctttgattgtgttacggtagttaactaggctttattcacatatctctactattctatatagtcaaagcaaggtggcagaaggacccaatgttgatattggtaaatcatgcgcaaatgggtgtgctgaaatgatggagaacaatagggaacatagaattgctcttgttgctgctggattagctgctggaatcgcttcaggtattttaattaattatttattccattcgtaatatggactcaatgaaccgaaaatgaaaggggtgtatttctagttttgtttcagcttgctaagatattggtcgtttttatcgaaaaattgcacttctgtttaggaagtagaaacattaaatgttttaagaataataaatatttgcttaaattcctttttataaccttcgtacaactgagtttcacatggatgtttaattaatttactactttaagaagcaatcccagatccacatctaattgtgcctccctgtattctgtatgatctatggagatcatgttgtatctttatggatccacagcagctcaacatgtggctaaaaatcagttgcatcagaaatattaagcaaattagacatgcaggcctatcaacttatttctggtataaagaaccgagatccttaaaaaagaagaaaatattttacttttgatgcagcttgctggactggaccccgttgtgttcttccgatgatcaatcagtcaatcacaaattcaaaccatacaaatcaagtatgtttttattttatattacggtgaaatgatactagaatttcactgacatgttacacaatttttctcagctcaatatccaacgtgcttctagaagtgtgttcaaggggtggagtgaggagaagatatattttgctcccacatacaagtactcttgcaactcatattcttatgctggagagactgccacatcaaagaaaaagaggagaaccccggcttggtatgtactacaatgtttgagacagtttcagagagttcagatctcattctcatatgttaacactcgtcagtggctatgaagtatcctaaagtgcacaaacctctttgcaacccgaaaaccttgtgtttcccctttctgtaccacaagaaccatcttttgagagagttaaatcagatttggacagcaaggtaagttgtaagcgtggggaaacacaaaagaggaatcattctcatgtgcaataaataaacaaatcaagatgattcacatattctgaattcaggaatcacacttcccaaaccatgaatacataatactattaatgacctgtttgttgcaaaatgttcaggtgtgatagaatactatggcatggagatggtattgcacagttgtcctacttccggggggaatctcaattctcttaccatcgtcctgtttgtgggacatttactgttgaggttaaaaggctagatggccgatcaaagcggcgcccatcaaacaccaacattataatcgatgcagttgttaccgacaagagacaagcataactaaggcacttatgtgtcttcagtcttcttgatattgcattaatatctgcaggcactacagcagtctatgggtccttaa

SEQ ID NO: 278 - DNA, 2008 bp, Zea Mays
ggcggcgagcgagacacctccacacgtctctcccccttccgtttcctcccgtccctgctcacacctctgtagctgcgcccgaccgaacccctcctaccccggaatcctccccccgatgcggcgccgataagggggcgagaccggcggaagagcggggaatggcggggcgcggcgagaagcggcgccggacaggaggggcccacgaggagcccgaggaggaggaccgcatctcggaccttcccgacgtgctgcgcctgcagattctgagcctgctgccgctcaaatcggccatccgcaccggcgcgctctcctcgcgctggcgccgcctctgggcgtaccgctggccggagccgtcctcggtgagcatccgcctcccgccgggcggcggcgccgccgccgccgcggcgaccgcggccgcgctcgcggtgatcgaccgccgcgggcggcgccgcgtcgacggcttctcgctcgccttccacggcgggcagctcgcgcaggcggacctcaagcgctgcgtcgactacgcggcggcgtgcgaggccgaggacctgcacctccgcgtagacggcggcgcgggcgccggcggccgcggctcgcgcggcggcacgcgccgcccgggcatgctcaccctgcagttccccatggggtccccgctgctcgtgcgcctgtcggtgcgcgggctcaacctcacggccgtcaacaacgccatggtcgccacgctcgaggtcgtccacctccactccgtcttcctcaccgacgccgcgctgcgccggatggtcgccgcctgtccccgcctccgggaccttgacctccgctactgccgccgcctgcgccgcgtcgacttcaccaacgtcggcgtgcccaacctcaggagcttcaccgtcgtcgactgctcccgtaccaccgagctgcgggtccccgtggctccccgcctccggtccttccgcttcagcggcgccttcctctccagcaacatcctatccggcgccaaggcctctctcgagcatctctacctctgctccggcgggccagagaccggccttccagtcaccaacttgccctacgcagttcctcgcctgtcgaacctcactgtcctcaccctctgcagcattgctctccaggtttttgctcaggcgtttgcgccatttccttccggcccatttcaccgcctctacgcttatacttgttcgccttgccttgcagtatgtttcttctttcacagccaaggatgtaatggagagcaacctacatggcttgagggagcttcatttgctcatgttcgggatggccaactccaaccttgctgacatctatagcttcctcaagacctgcccgtgtcctcagttagagcgcctctttgtgcaggtctctgtttttcttcttcttatcttcttgaaaaactgcattcgattgctttgtttgtttatgggtatctgatctgtttctcaacatgctccactgaacatgcagctcccgacaaacaccggtgatgcattcacggagaacttcttgaaggtggaggaggaggacccgccaaaaggtggattagaaaaccttcgcttagccaagctgacaaatttcaaggggcaccgtaatgagatgcagctagtagcatttctgcttagacagtctagtagtctgaagaaactatttttgattgctcccaaggaggatcaccctcaaggactgcgcaaggttcattcagatatgctgcctgattttcttaaaaaagaaatatcgcatctggaaagagcttcagcaaatacccagatatttttcggcgagcctgatgctcagacccacccgttgcattcggaggtctttgtcaggttttagcttgaaatgagcaaaagctgttgtagcccaattcctgctcatatagatttagatttctcgttgttagataacggacatggggaaaaaagtatctgcaaggcatacagagtttgatatatgtttcctcttttgcaattcatattactaaagaagtcctgcatagcagttgaaa

SEQ ID NO: 279 - DNA, 3760 bp, Zea Mays
gcgtggaagccatggccgctcccccaagagaaaataaaaatgtagcagtagcttgcaagcgggaaagccaagaaggcgtgtctcgcacctgtctctgaccaagacgcgcgcatggaagagaaagcgtcgggaggcggttgagatgcgtgggcgggcgggcggccaggcatccacacgtctgacgcctccccgcggtcggcgcctcggcgtggcaatataccggcgtgccccgagcgcgccggggccttcttctactcgaggcgtggcaactcccgcgtgcgcgaggccggcttccttggacctgctgccgccctcgccaccggcgatagccgcccgccgcatccattccctcgccttctcgccacggcgccaggcaaacgatgcacaagaaaaaaggagggacaaaacaaagagggaaaagaacgagcggcgtgggccgttggcccatcgggcccttggagaaattaggcaagtggggcccagtgacatggccgctctggctgtccacggccggtcagccgcgagcgagagctgggctgagctgccgtgcgcgtgctaacctggactgggcagcaggcatcagacgcatctcgcggcatctcggcatgtggaagctgtgaagaggagaagacgcggagaggagatgctgcaacagaagccgaaccgaacgaaaggaaggagagagagagagagagagagaaaaaaaaaggacggctccgcccaagggtcggaagggagggagttgccgcgccgcggccggttcgatcctttgcgcgagatcgagcttctccggttggtgttggggctggcgacatctgggatccgtcgtctctcctcgtgttcttgagcaggtgacgatttactctttgttgcgtgtgcatgggtgggggtcgatctgcctggttgtttaagggcgtaatcgcactgttctgtgattagtttaggaccaccgaggtcgcagcttacttttgcggtggactaggattcgggatgctttgtgatttagccttcagcgggtggtaggaccgtaggaggattcccgtggtaatcgctggtgagattttgctctggtttcggattttggggttagcttctgctgaagtgcttgttcgagcaaactaatatccaagcatttagcggtgctgcgtggtacgcgtacgccccccattttagactatacttgagctccaattgcccaactgatattagttttgcagtattgttttgcagattcctgagatacctaccaacccctgatctccaattgcccaattgatccccatttgagttattactagttgttgattccaattccattacatgtttgccctaactagatattcccttttccgtgcagttttccacttgcctggcaaaagaacatttgacttggaagagcaaacactggaagctttgtggtttgtcctaagtgatcctatcaagttctcataggctgcatactggtacagcattttctcctgtgttttgggccacagaagaggggggagccaaggatttttctatctcgtaagccgcggccttggtgctcatagttaccctagtctgtaagctggagattgtaaaaagccatatctgttcctctatcactgtatatagagatctacataatggacgagaggaggactattttgatggaccgttacgaaatcgggaggcagttaggccaaggaaacttcgccaaggtatactttgctcggaacctgaccgacgggcagtccgttgcgataaagatgatcgataaggacaagatcacgagggttgggctaatagtgcagataaagagggagatctctataatgaggctggtgaagcatccgaatgtcctgcagctcttcgaggtaatggctagcaagagcaagatctacttcgtattggagtacgctaaaggcggcgagctgttcaacaaagtatcaaaggcgaagctcagcgaggatgccgcgaggaggtatttccaccagctggttaatgccgtggactactgccacagccgaggcgtctaccatcgcgacttgaagccggaaaacctactcctggacgagaacgagaaccttagagtctcggacttcggtctgagcgccctgtctgaatccagaaggcacgacggcctcctacataccacgtgtggaacccctgcctatgttgctcctgaagtgcttggtaggagaggctacgatggcaccaaggcggacatatggtcctgcggagtgattctcttcgtgctcgtggctggttacctgccgttccacgacccgaatctcatcgagatgtacaggaagatctccagagctgaatacagatgccctcgctccttctccggtgagctgaaggacctgcttttcagaatgctcgatccagatcccagtaccaggatatccatttcaaggatcaagagaagcacttggtacagaaaacctatcgaggcaaacgcggcaaagatcaagcacggcacagcaagagacaccaccgtgcgcgacggtgaagccgccacggcctcgagctcgatagagtgcagtaaccggccagaggaagaccaagggtcgtcaagcctccctaacctgaacgcattcgacatcatttctctctcgaccgggtttgacctatctaacctgttcgaagaaagacacgggcggagggaggagaggttcaccaccaggcagccagtgggagcggtgtttggtaggctgaaggagctggctgagcggttgaagctgaaaatccagaagaaggagagcggggtcttgaaactggctgcgcagaaggaagggatgaaggggttcctggagctcgacgccgaggttttcgagcttgccccttcgttccttctggtcgagctgaagaaggccagcggtgacaccattgagtaccaaaggctcgtgagggaagaagtgcggcctgcgctgaaggatatggtctgggcttggcagagcgaccggcaccagcagcagcagcagcggtgcgagcagtctgtgcaaggagaggaccagcagcagccgttgtcgtctttgccgacgcagcagtagtcactgcaccaccagttgcgaccgccataaccagatcacgtcaaaactgcaccaagccgcacaggactagtaactcccacttgcatcgacgcttatgtgattgcggaattgtgtttcaggttacctgcctgctgcggtaggacctaaaacgcctacctgcctaccatttggcatttttttgtatactgtacgtacattagagtaataaacaaacatgcttaacttttcagctttcgattggaatgtgcttttcgatgtaactctgtaaccagtgtaggtacgaagtcgattagccacagggtctggccatgttgacctcacgtagccctggttcattggtgtaacagtttgttggctgcggctttacattattttgtctctatggattacggctgcgactatgtgtagctgaacaagctggtatatgatgagccctggaaacgtgtgtttactgcagctatttgcagccagtgactgttgatacaaacgacgaagtagagttggttgtttatgtaggcacgcagcatgaccataattatccatgaatcatggatagatgcacaatgtttaggaaacaggtgtgtgtggctggctggtggtgcgagaagagatgcgctgccttgatgtactgtactgggactgggagggatgcgtctcgcagtacagtctgtactatcatctctacacgcacgcacgcaggctcgacgtgtcggcggcgg

SEQ ID NO: 280 - DNA, 4074 bp, Zea Mays
caagtgatgaggggtttaggattcgtgttgctgttggtggcagctgcagcattgatcaggccatcagaagtagtaggggcagaggaggaggactgggagcttttcttgttgcagtggaggcagcataattctcttccatccccacttctcaatggggatctggtaagtcatccagacactattgtttatagcatctgagagcgactgattcatggaatgcctgcttcctttgtgcccgggatctgccagaaatttgcaatgcgaattccttttgtgttctcgaaaatttgaaattagctgctgacctgctacttaaaataaaaaaggtcctgaattcaccaagtacttcacttaccaaactaatgcagggacagcttttcagaatttgtcagtttgtttttccctgtattctgggtacttttggttggagtattgctattgaactcttttcttctgcaagatccaagaaagtgaggcattagcaaaggtagactgatgtaggatggttcttggatggatgcaggtggatagaatatggtcaatttgcttaccagacatggccggtgcacaggaaatattgggcaatccactgcaatttgcttcagatcagctattgagtcagccatcagaaaatgctttgaaggcaatgctgtttctggagtttctgtctcttctttcccctgaaaaattatccagtacctatggttgcatccatgcaaactacttcggtttgggcattccacaagaactcagtgtttcactggcaacctaccttgagagccatcagctgttgcttggttcgaacttctatgcgagacggcatttggctgacaactcaattggagatgctccttccatggctccagattttgcgccgtccatgtcctctggcgatgacgtgaagcttcctcagtctgttacagaaacaccgtatgcaccttccagctcttacaacaatgaaaatccaaaccgacctcatcacagtaaacctgcacagaagcatcggggagtacctccaatttcacttctggagaagcataaagactatgttagattagtcttgatcgtggttctaccaacagcggcattctcgttcattgctgcttttctaattttctactgctgcggatgcaacaagaacaaggtctctgtcggtgagcaacgagatgatcatcctcttcttcacatgcagttggctaatgtacctggtgagacagtatccctttgtcaacctgtgatggcctcatgggttgttcttacttctttagtataataatactataacacacaacattctgttctcaggttcatcacccgatgcccgtgtttctgccagtcaccttaacaaggataatcgaagtcattctggagtcagcatgagtcggtgcttttcatgctgttttaaaagatccactgatgccacaccatcttcagaagtgattggaggaacaccagagaataatgtcacaagtgatgctcctaaaccgatgtcgcctccagctcctccacctttgccacctccgatcaagaaggctcctcctcccccacctggacctcccagaggttctaaagcaagacttgctcagctgtcacctgttgagtcaagtcgttctgaaggatcatctgccagcgagcagaccagcgaatcatctgaagcagaagttaatgctccaagaaccaagcttcgacctttctattgggacaaagttcttgctaatcctgatcagtcaatggcatggcatgatatcaaattcggttcttttcagtaagtgttactagtagcaataaactcttaatacactatgtctgcagagtgcttgttttcacaatttgattttgcagtgtgaatgaagatatgatagaggaattgtttggttatagtggtggaagcagaaataaccttaaggataaggaactcccctctgcggatcctgcatctcagcacatttctcttctcaatgttaagaaatcatgcaacctggcagttgttttaaaggcaatgaatatcagggtacaagacattcatgacgctcttattgaaggtagttgtttattcacaagaagccgatatcgatttgcccttaagcatatctcttaatgataagccaagccatttgcacagacttagatcactgttgacacacttgaaaatgagttttcttttagaaaactttgctgatgaattgtacagtagtcattaacttttttttaagttattcagaaagtattatcatctttcccttgtagcttacttaattgtattgagaataaaatcccattcgatatatctctagaatctatgtaggttacttagacgacaatacacttataagcgtatttttagaaactctgttcatgatcatatattggtcactcactaccattttttaagctaaccatttgtgtacaacatgaactttgtcagactatgtattaggcagtttttccaatctacttcatgttggacattctattttagtgccttatgcttgtgtcatttcatttatggaggactcaaggaaatcttttctgcttcagaatatatattcttctgttacttcttttatttactgacatcagcatgaatctgaaagacagaaacgaatcagttagccttatagaaatgcatttcatctgggtagtaactgtagcgacctcaatcttatgattttctgatgttgtatcctgtttgcatttgggagttgttctgcttcttcttgagcctttttttttttgctcgctcatgttgattcaccagccttccagatgaggctcctttctgaatacttctcattttgtgtcccggttctcctacagtgccattatttttttctgacattattttcatctcatcctgttcacaagggaacgaacttccaagggtgcttcttgagacaatcttgagaatgaaaccaactgacgaggaggaacagaatctcaggctttataacggggatttctcgcagctaggccttgcagaacaagtgatgaaggcattaattgacacgccttttgctttcaagagggttgacatgttgcttttcatgtcctccttgcaagaagatgcttcaagtctcagggattcgttccaccaattggaggtaatcaaccttacaaaagttgtgtcaaatctgcaaaaaggaaatgcactaactgtcaactacatctttttgttggtaggccgcttgtggggaactgaagcaccgcctttttctcaagttactagaagccgtgctcaaaactggaaaccgtttgaatgatggaaccttccgtggtggtgctaatgcattcaagcttgacactctcctgaagctatcagatgtcaagggtgctgatggaaagaccacattgctgcactttgttgtgcaggagattgttcggtccgaaggtgtccgcgaagcaaggctagccatggaaaacggaagaagtccagctcatagtgcttcagatgacacttccaatggatctcttgaagaggacggtgatcactactccaaccgcggacttagcattgtgtcaggacttagcagtgagatggacaacgtcaagagggtagccgcactggatgctgagcctctgtttgccactgtggtgaccctcagacaagagttgctgaaatcaagggagttcctgaatgaaattgcgacagtagaagagacgagtggattcagacgttcgttggaaagctttgtggaacacgcggataatgagacggggtttttgttgaaagaagagaagaggttgagatcgttggtgaagaaaacaatccggtatttccatggaaacgactctaaagacgacggtttccggttgtttgtggttgtgagagatttcttggtgatgctagataaggcgtgcaaggaggtcggggcatcacagaagggtacgaataaatcacgaagcagtggcagtggcagtggcaatggcaatggcaaccctacgttcccgtcaatcctacaggagcaacagttccctgctgttattgatggccattcagatagttcacatactagcaattgacgatgagatactaacctttttttgtaaagaaaaaaaaatccgttttggagagga

SEQ ID NO: 281 - DNA, 3392 bp, Zea Mays
attcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatgcagatctttgtgaaaaccctgactggcaagactatcaccctcgaggtggagtcgtctgacaccattgacaacgttaaggccaagatccaggacaaggagggcatccccccagaccagcagcggctcatctttgctggcaaacagcttgaggacgggcgcacgcttgctgactacaacatccagaaggagagcaccctccaccttgtgctccgtctcaggggaggcatgcagatctttgtgaaaaccctgaccggcaagactatcaccctcgaggtggagtcctctgacaccattgacaacgtcaaggccaagatccaggacaaggagggcatccctccagaccagcagcggctcatctttgctgggaagcagcttgaggacgggcgcacgcttgccgactacaacatccagaaggagagcaccctccacttggtgctgcgcctcaggggaggcatgcagatcttcgtgaagaccctgaccggcaagactatcaccctcgaggtggagtcttcagacaccatcgacaacgtcaaggccaagatccaggacaaggagggcattcccccagaccagcagcggctcatctttgctggaaagcagcttgaggacgggcgcacgcttgccgactacaacatccagaaggagagcaccctccacttggtgctgcgcctcaggggaggcatgcagatcttcgtgaagaccctgaccggcaagactatcaccctcgaggtggagtcttcagacaccatcgacaatgtcaaggccaagatccaggacaaggagggcatcccaccggaccagcagcgtttgatcttcgctggcaagcagctggaggatggccgcacccttgcggattacaacatccagaaggagagcaccctccacctggtgctccgtctcaggggtggtatgcagatctttgtgaagacactcactggcaagacaatcacccttgaggtggagtcttcggataccattgacaatgtcaaggccaagatccaggacaaggagggcatcccacccgaccagcagcgcctcatcttcgccggcaagcagctggaggatggccgcaccctggcggattacaacatccagaaggagagcactctccacctggtgctccgcctcaggggtggcatgcagatttttgtgaagacattgactggcaagaccatcaccttggaggtggagagctctgacaccattgacaatgtgaaggccaagatccaggacaaggagggcattcccccagaccagcagcgtctgatctttgcgggcaagcagctggaggatggccgcactctcgcggactacaacatccagaaggagagcacccttcaccttgttctccgcctcagaggtggtatgcagatctttgtaaagaccctgactggaaaaaccataaccctggaggttgagagctcggacaccatcgacaatgtgaaggcgaagatccaggacaaggagggcatccccccggaccagcagcgtctgatcttcgccggcaaacagctggaggatggccgcaccctagcagactacaacatccaaaaggagagcaccctccaccttgtgctccgtctccgtggtggtcagtaagtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctgcaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgat

SEQ ID NO: 282 - DNA, 2900 bp, Zea Mays
aacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatgcagatctttgtgaaaaccctgactggcaagactatcaccctcgaggtggagtcgtctgacaccattgacaacgttaaggccaagatccaggacaaggagggcatccccccagaccagcagcggctcatctttgctggcaaacagcttgaggacgggcgcacgcttgctgactacaacatccagaaggagagcaccctccaccttgtgctccgtctcaggggaggcatgcagatctttgtgaaaaccctgaccggcaagactatcaccctcgaggtggagtcctctgacaccattgacaacgtcaaggccaagatccaggacaaggagggcatccctccagaccagcagcggctcatctttgctgggaagcagcttgaggacgggcgcacgcttgccgactacaacatccagaaggagagcaccctccacttggtgctgcgcctcaggggaggcatgcagatcttcgtgaagaccctgaccggcaagactatcaccctcgaggtggagtcttcagacaccatcgacaacgtcaaggccaagatccaggacaaggagggcattcccccagaccagcagcggctcatctttgctggaaagcagcttgaggacgggcgcacgcttgccgactacaacatccagaaggagagcaccctccacttggtgctgcgcctcaggggaggcatgcagatcttcgtgaagaccctgaccggcaagactatcaccctcgaggtggagtcttcagacaccatcgacaatgtcaaggccaagatccaggacaaggagggcatcccaccggaccagcagcgtttgatcttcgctggcaagcagctggaggatggccgcacccttgcggattacaacatccagaaggagagcaccctccacctggtgctccgtctcaggggtggtatgcagatctttgtgaagacactcactggcaagacaatcacccttgaggtggagtcttcggataccattgacaatgtcaaggccaagatccaggacaaggagggcatcccacccgaccagcagcgcctcatcttcgccggcaagcagctggaggatggccgcaccctggcggattacaacatccagaaggagagcactctccacctggtgctccgcctcaggggtggcatgcagatttttgtgaagacattgactggcaagaccatcaccttggaggtggagagctctgacaccattgacaatgtgaaggccaagatccaggacaaggagggcattcccccagaccagcagcgtctgatctttgcgggcaagcagctggaggatggccgcactctcgcggactacaacatccagaaggagagcacccttcaccttgttctccgcctcagaggtggtatgcagatctttgtaaagaccctgactggaaaaaccataaccctggaggttgagagctcggacaccatcgacaatgtgaaggcgaagatccaggacaaggagggcatccccccggaccagcagcgtctgatcttcgccggcaaacagctggaggatggccgcaccctagcagactacaacatccaaaaggagagcaccctccaccttgtgctccgtctccgtggtggtcagtaagtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgtt

SEQ ID NO: 283 - DNA, 2859 bp, Zea Mays
aacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatgcagatctttgtgaaaaccctgactggcaagactatcaccctcgaggtggagtcgtctgacaccattgacaacgttaaggccaagatccaggacaaggagggcatccccccagaccagcagcggctcatctttgctggcaaacagcttgaggacgggcgcacgcttgctgactacaacatccagaaggagagcaccctccaccttgtgctccgtctcaggggaggcatgcagatctttgtgaaaaccctgaccggcaagactatcaccctcgaggtggagtcctctgacaccattgacaacgtcaaggccaagatccaggacaaggagggcatccctccagaccagcagcggctcatctttgctgggaagcagcttgaggacgggcgcacgcttgccgactacaacatccagaaggagagcaccctccacttggtgctgcgcctcaggggaggcatgcagatcttcgtgaagaccctgaccggcaagactatcaccctcgaggtggagtcttcagacaccatcgacaacgtcaaggccaagatccaggacaaggagggcattcccccagaccagcagcggctcatctttgctggaaagcagcttgaggacgggcgcacgcttgccgactacaacatccagaaggagagcaccctccacttggtgctgcgcctcaggggaggcatgcagatcttcgtgaagaccctgaccggcaagactatcaccctcgaggtggagtcttcagacaccatcgacaatgtcaaggccaagatccaggacaaggagggcatcccaccggaccagcagcgtttgatcttcgctggcaagcagctggaggatggccgcacccttgcggattacaacatccagaaggagagcaccctccacctggtgctccgtctcaggggtggtatgcagatctttgtgaagacactcactggcaagacaatcacccttgaggtggagtcttcggataccattgacaatgtcaaggccaagatccaggacaaggagggcatcccacccgaccagcagcgcctcatcttcgccggcaagcagctggaggatggccgcaccctggcggattacaacatccagaaggagagcactctccacctggtgctccgcctcaggggtggcatgcagatttttgtgaagacattgactggcaagaccatcaccttggaggtggagagctctgacaccattgacaatgtgaaggccaagatccaggacaaggagggcattcccccagaccagcagcgtctgatctttgcgggcaagcagctggaggatggccgcactctcgcggactacaacatccagaaggagagcacccttcaccttgttctccgcctcagaggtggtatgcagatctttgtaaagaccctgactggaaaaaccataaccctggaggttgagagctcggacaccatcgacaatgtgaaggcgaagatccaggacaaggagggcatccccccggaccagcagcgtctgatcttcgccggcaaacagctggaggatggccgcaccctagcagactacaacatccaaaaggagagcaccctccaccttgtgctccgtctccgtggtggtcagtaagtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaa

SEQ ID NO: 284 - DNA, 6444 bp, Zea Mays
accctactccatcttctcgtgttgttcggcgcacgcggagacagcccgcgatcccgatcccgatccttcttcacgcgaatctcgacgatcccccccttccttccttcaaggtacggcgaatcggcgatcatcctcccgctttcccttctcctctaggtataatgatttgttataggttatggggacttttgagtcatcgggtcgatctgacgatttgctatgggtgctctgagtactcgacctgggaactgtggggcgcttgtaggcggcgcagagttgggtctcgtcgttgtaatgattccatcggctcgttgcgtagggtttgatctgcctgtcgttttcttttcttttaattaaatttctgatgcacagtcatgtattgatctggtttggtgttcctagatgcgtgtaataaatggggaaaaaaccatgtcgtaataaaatcaatttatttttaataaaaaaaatctgaattctggctctagtgaataaatggatagagcctggctctaattctggtaaaataaaaagacaacgagcttaacttcttaattggtcaattggaagggttctccgatctaattagacgttgaaaatatattgcaagattacttcacttctttaaattgccaagaaaccataaatttaccattgtgattggggctacttttttttaacctttagcctttgtgaaatttaaccgaatctgttcattttggtatttgagtgtttttaatggattagaaattctttcttttcatgtcttaccaattcagtggtgtaatttcatctagattctgatcgtatctaagagatcctagttctgtcgtttttttaacatccagaaggagagcaccctccacctggtgctccgcctgaggggtggcaatggtaatgcagatctttgtgaagaccttgactgccatgtatgataccgtctttgaagtatttgtattgtctgtcgtgactaagtttgtttcgtggaccggttgtcttctaccctacccaaaactacagtgtggcagcaaatgatgaataaatgtgatgtttgaatttaaaaatatgtgctgaataatgttgtttttttgttatgtcagttaatgttactaaattggctagcttttaaattttgtttactagtgttcgtcgcacctacatctttgtactgaatgtttgctttaggttctgacaaactcattttgagactagttaaatacttaggacctaaaatgaatgcagtaaatatttatcatattttctatgaatttggtcagacttaatttggctgaatccaaacctaatgtttttttactaatcatattgatatacatgtttgattgtctgattatctggtttgttactattttacttggttcgggtctctatttcttggtgaatctacatagacttgtgcagaacctggttgtgatcataattctacttcctctggagataaagtggcttgcttttctgtatgtctaattttttgtttgaccattgaaaaacaaacaaccaacttacggatcaaatcagtattactgccagaagtatatttgacccttaacactatttataaattacataaagtttcacgattaaaactgacggacggatgttattggcctagaaatagctcgaaagctctaggcttaacaacccttgcactaaattattgtgattaacgttgtactttatagtgacaaaaattaattggaattatatagtttcttttgttttgtagaagcaaactaagttaggctataataatatagatagatgattaggtttatatatggtttcttttgtgaattttattaaggatcaactagtgtcatgaagttgatagacataaaatagcgacacatttcttttgccgtactataaaaagcgctggaataattaagatagtcaagagggtgaatttggtgtctctaacttttcttggacaaatttaaattttgaacacaagcttaactatctccgtgtgttcaataacgtgtctaataatatgataaaaagtttatatcctgattttctattttatactacgatggtaattttaaggatgctaattttaaaattgaattgcttaaatataaatgtataaaataagtaaaagatcaatggactcctcgatgttttgtattatagatgttgttaattgattaacttgtactgagttatttaagagcaaggtagtaagctgttgccaacaactgattcggttgtcacggattagtggccttaaataatttctagccggattacttctctaatcttaacgatttctgatctatttcttaaaaaacgaataaggtctgaatcaagatcagagctggagatgtgcatgggtgcatctcatatggcacaccgcagacaaaagattgcatagttggctccgatcctatttggcaagtgattagagatggcaatggcccaatggttacccgcgatccgatactcgatgagtatttactctattagggtatatatatggtctaaatgttctacctatggatttcttgttaggtaaaaaccttcaaccaattggtaaacgggtataagaaaattctgtccctacccatacttgttaacccgtgggtataaacttagcctaaaaacatgaacttgggctttacttatatatttcttttgacttagcctaaaaacatgaacttgggctttacttatatatctcttttgactatttaacaaccttttcggcgataataccatagaaggcttaacaactatttgatgatcatgtaatagaacatgtaatgtgttatgtgttactatcctagtgttgctactatatccaattatctatggtgttcttgaatagatgattgaatgatgttagaaattttgtaatggatatattgacatttgtataatgtagatgtttaatctttgtgagtacggatctgacgggtaactcatacctatatgggtaatataagtgacccgatgggactattttttttatcttaggtatggatatgagatagataagagatcataatgctcatgtacgccatcaatgccatttttttaaatgaacaacatttgaagccttttccatgagaaagagaaaggggaactaagatatttatagaagttccttagagcaacttcaataggaaccctaatcacataaacaaattaaaatatagagctttaataagaaaagacagctacccaagagccttattttaatgaaattcgtgtaaacttgaagggtagcatatttggatctgagatccgcagccctatatggttcgcgctcgtcccaaccacctcggatattttcgctttcttcttcgccgccaccggctcccattccaccgccaaggtcagcttcgtttccatcgccgcatcgcgttcgcgtgtgccaaccccgctcccatctcaactgtcaccgtccgaagaactgatccgttctgcacaaccgctcgtcactctccaaatttgctgcacctgccctctccaaagttcttgcactcgtccctctccaaagttcctgcagattcacttctctccaaagttcaggaggatgtgtggtgtgacagcgctacaacaaatctgtcaacggggactctcatcctcttgctcatagaaagaactgcagtgttacaggtaggtaattactagagtactactactaagtaaatctgtcaaaggcagtcatggcatccatatccttcacatcagtactgggagtggcacacgcaccgcacacatactactacatctactagtatgtagtggagtgcttgaaaggcataagcgaattttcttcttgtttggtctacgtccatttgcttgtccactaaccggctagtttactctgctttttgggttttccacgtctctacaattgtgactgttagagcaactccagtagttctctaaaaaatagcttgctaaaatcatgtttagcaagttgctaaatagctattggaagtaaaaaataacttagtttccaatagttgctcatatttaggaagtagttcgattttgaatctagctttagcggccctgtccctatgagatctgcctgataataaggttgagagcagaggatatgagggcggaagaaaaaaggtcggtcgatatgaattatggatgagtggtggtccggtgacgcaacttatgagaaagttaggttcgacggtgaaggagaaacttgcgtcatacgtgtttgacctagctacctcattatgctagaaaataaaaaagagtgtgttataactggctatctcactgtataggaaaggtaaaaataatcacgctagtgtgaagaaattgacgtcaactgtatttagggagttcctaccgagttgctaaatgtggagagtaaatagagttgaatagcaactaactaaatttagcaagtctatttagagaaccattggagaagtatttttctgttcacttcttaaatttaagatttagagagttatttagagaactattgaagttgctcttagaccacctataattgtgactgttgaccacctatagatgcggttcaactagccctccgaccccctctcgagagttccgctccaccgcggcgaaggaagtggcggaggaggaggatccgcgcctgcgctgggccttcgtgcggaaggtgtacgcggccccccgctgccgtctggcccacgtacatcgccatcctcctatccctgtccccgctcggactcttcctcgctaccgccgtgtctgcggatctggccaagtagcccggtaggaagcgccgtgggaggagacaggcgaggcgttcgaccgccgccggcagcttaggacgtaccacgtctctgttctatgggttcacgagtttcggggccctacatggattctccgcctccgcctccgcctcgtccgccatcgccgccgcgacaccctcctcaccctcagggcgagcgtcacgtcggcggggagatgctgtaccaggacacagaccataggctccgcgcgctggtcgggagcgccgagggcttcggccgccacgccatcgggggcctctacggggccatccaccgcgtcacgtcgctccaaggtacgttacgtacggcaaggagttagatcgtgcccagcgcttcctgatcctttgattcctgaatgaatcggcgcagacgacgggcccgggagtctgagggaggcgtgccgggcggaggagcccctgtggatcgtcttcgaggtgtccggcaccatccacctccactcctacctccgcgtctcctcgtacaagaccatcgacgggcgcggccagcgcgtggtgctcaccggcaaggggctccggctcaagtcatgccatcacgtcatcatctgcaacctggtgttagaaggaggccgtgggcacgacgtggatggcatccaggtcaagcccgactccaccaacatctggatcgaccgctgcaccctcgccgactacgatgacggcctcatcgacatcacgcgccagagcacagacatcacagtctcaaggtcttttcactcttccttcccctgtaaatcttattactatattgcaaaaaaaaaaactgctatccgatgcggaaattttgtagtaatcgatatattagcttcacgattgaaccaaccaattaacaaattactgcacgcagatgccattttatgcggcacgacaagacgatgctcatcggtgccgaccccacgcacgtcggcgaccgctgcatcagggtcaccatccaccactgcttcttcgacggcacgcgacagaggcacccccgcctccgcttcggaaaggttcacctctacaacaactacacgcgcagctggggcatctacgccgtctgcgcaggcgtagaggcccagatcgtgtcccagtgcaacatctacgaggcaggtggagggcccccaaagaagacaactgtattcaagtacatgccggagaaggccggcgaccgagaggacgtggtggcagggtcgatcagctcggaaggggacgccttcctcaatggcgcgctgccctgcctgatcgataaccctgggtctgtcttcaggccagaggagtactaccagcagtggaccatggagccagcgtcgccggcgctcaaggacataatacagctctgcgcaggatggcagccggtgccccgccccccggatgatcgctgactttcatcattctgatatgctgcagctcgcttctgtaagaatattcgtttcacggaagcactgcatttgtatgcatctcatcctaggtaattcaacatttgtttcatggtagagtggcatttgtatgccactcctcttcatctgccccctctctgaaatgtagtagaaaagttgttatggttttctatttgtgtctttatttatggtacatacaattcccaatgtaaagatatttctctcgtccatagcagtacaatagcttttagttgtgaatgctactcgtatgtcttatactag

SEQ ID NO: 285 - DNA, 2845 bp, Zea Mays
caaatctgtcaacggggactctcatcctcttgctcatagaaagaactgcagtgttacaggtaggtaattactagagtactactactaagtaaatctgtcaaaggcagtcatggcatccatatccttcacatcagtactgggagtggcacacgcaccgcacacatactactacatctactagtatgtagtggagtgcttgaaaggcataagcgaattttcttcttgtttggtctacgtccatttgcttgtccactaaccggctagtttactctgctttttgggttttccacgtctctacaattgtgactgttagagcaactccagtagttctctaaaaaatagcttgctaaaatcatgtttagcaagttgctaaatagctattggaagtaaaaaataacttagtttccaatagttgctcatatttaggaagtagttcgattttgaatctagctttagcggccctgtccctatgagatctgcctgataataaggttgagagcagaggatatgagggcggaagaaaaaaggtcggtcgatatgaattatggatgagtggtggtccggtgacgcaacttatgagaaagttaggttcgacggtgaaggagaaacttgcgtcatacgtgtttgacctagctacctcattatgctagaaaataaaaaagagtgtgttataactggctatctcactgtataggaaaggtaaaaataatcacgctagtgtgaagaaattgacgtcaactgtatttagggagttcctaccgagttgctaaatgtggagagtaaatagagttgaatagcaactaactaaatttagcaagtctatttagagaaccattggagaagtatttttctgttcacttcttaaatttaagatttagagagttatttagagaactattgaagttgctcttagaccacctataattgtgactgttgaccacctatagatgcggttcaactagccctccgaccccctctcgagagttccgctccaccgcggcgaaggaagtggcggaggaggaggatccgcgcctgcgctgggccttcgtgcggaaggtgtacgcggccccccgctgccgtctggcccacgtacatcgccatcctcctatccctgtccccgctcggactcttcctcgctaccgccgtgtctgcggatctggccaagtagcccggtaggaagcgccgtgggaggagacaggcgaggcgttcgaccgccgccggcagcttaggacgtaccacgtctctgttctatgggttcacgagtttcggggccctacatggattctccgcctccgcctccgcctcgtccgccatcgccgccgcgacaccctcctcaccctcagggcgagcgtcacgtcggcggggagatgctgtaccaggacacagaccataggctccgcgcgctggtcgggagcgccgagggcttcggccgccacgccatcgggggcctctacggggccatccaccgcgtcacgtcgctccaaggtacgttacgtacggcaaggagttagatcgtgcccagcgcttcctgatcctttgattcctgaatgaatcggcgcagacgacgggcccgggagtctgagggaggcgtgccgggcggaggagcccctgtggatcgtcttcgaggtgtccggcaccatccacctccactcctacctccgcgtctcctcgtacaagaccatcgacgggcgcggccagcgcgtggtgctcaccggcaaggggctccggctcaagtcatgccatcacgtcatcatctgcaacctggtgttagaaggaggccgtgggcacgacgtggatggcatccaggtcaagcccgactccaccaacatctggatcgaccgctgcaccctcgccgactacgatgacggcctcatcgacatcacgcgccagagcacagacatcacagtctcaaggtcttttcactcttccttcccctgtaaatcttattactatattgcaaaaaaaaaaactgctatccgatgcggaaattttgtagtaatcgatatattagcttcacgattgaaccaaccaattaacaaattactgcacgcagatgccattttatgcggcacgacaagacgatgctcatcggtgccgaccccacgcacgtcggcgaccgctgcatcagggtcaccatccaccactgcttcttcgacggcacgcgacagaggcacccccgcctccgcttcggaaaggttcacctctacaacaactacacgcgcagctggggcatctacgccgtctgcgcaggcgtagaggcccagatcgtgtcccagtgcaacatctacgaggcaggtggagggcccccaaagaagacaactgtattcaagtacatgccggagaaggccggcgaccgagaggacgtggtggcagggtcgatcagctcggaaggggacgccttcctcaatggcgcgctgccctgcctgatcgataaccctgggtctgtcttcaggccagaggagtactaccagcagtggaccatggagccagcgtcgccggcgctcaaggacataatacagctctgcgcaggatggcagccggtgccccgccccccggatgatcgctgactttcatcattctgatatgctgcagctcgcttctgtaagaatattcgtttcacggaagcactgcatttgtatgcatctcatcctaggtaattcaacatttgtttcatggtagagtggcatttgtatgccactcctcttcatctgccccctctctgaaatgtagtagaaaagttgttatggttttctatttgtgtctttatttatggtacatacaattcccaatgtaaagatatttctctcgtccatagcagtacaatagcttttagttgtgaatgcta

SEQ ID NO: 286 - DNA, 6396 bp, Zea Mays
cgcacgcggagacagcccgcgatcccgatcccgatccttcttcacgcgaatctcgacgatcccccccttccttccttcaaggtacggcgaatcggcgatcatcctcccgctttcccttctcctctaggtataatgatttgttataggttatggggacttttgagtcatcgggtcgatctgacgatttgctatgggtgctctgagtactcgacctgggaactgtggggcgcttgtaggcggcgcagagttgggtctcgtcgttgtaatgattccatcggctcgttgcgtagggtttgatctgcctgtcgttttcttttcttttaattaaatttctgatgcacagtcatgtattgatctggtttggtgttcctagatgcgtgtaataaatggggaaaaaaccatgtcgtaataaaatcaatttatttttaataaaaaaaatctgaattctggctctagtgaataaatggatagagcctggctctaattctggtaaaataaaaagacaacgagcttaacttcttaattggtcaattggaagggttctccgatctaattagacgttgaaaatatattgcaagattacttcacttctttaaattgccaagaaaccataaatttaccattgtgattggggctacttttttttaacctttagcctttgtgaaatttaaccgaatctgttcattttggtatttgagtgtttttaatggattagaaattctttcttttcatgtcttaccaattcagtggtgtaatttcatctagattctgatcgtatctaagagatcctagttctgtcgtttttttaacatccagaaggagagcaccctccacctggtgctccgcctgaggggtggcaatggtaatgcagatctttgtgaagaccttgactgccatgtatgataccgtctttgaagtatttgtattgtctgtcgtgactaagtttgtttcgtggaccggttgtcttctaccctacccaaaactacagtgtggcagcaaatgatgaataaatgtgatgtttgaatttaaaaatatgtgctgaataatgttgtttttttgttatgtcagttaatgttactaaattggctagcttttaaattttgtttactagtgttcgtcgcacctacatctttgtactgaatgtttgctttaggttctgacaaactcattttgagactagttaaatacttaggacctaaaatgaatgcagtaaatatttatcatattttctatgaatttggtcagacttaatttggctgaatccaaacctaatgtttttttactaatcatattgatatacatgtttgattgtctgattatctggtttgttactattttacttggttcgggtctctatttcttggtgaatctacatagacttgtgcagaacctggttgtgatcataattctacttcctctggagataaagtggcttgcttttctgtatgtctaattttttgtttgaccattgaaaaacaaacaaccaacttacggatcaaatcagtattactgccagaagtatatttgacccttaacactatttataaattacataaagtttcacgattaaaactgacggacggatgttattggcctagaaatagctcgaaagctctaggcttaacaacccttgcactaaattattgtgattaacgttgtactttatagtgacaaaaattaattggaattatatagtttcttttgttttgtagaagcaaactaagttaggctataataatatagatagatgattaggtttatatatggtttcttttgtgaattttattaaggatcaactagtgtcatgaagttgatagacataaaatagcgacacatttcttttgccgtactataaaaagcgctggaataattaagatagtcaagagggtgaatttggtgtctctaacttttcttggacaaatttaaattttgaacacaagcttaactatctccgtgtgttcaataacgtgtctaataatatgataaaaagtttatatcctgattttctattttatactacgatggtaattttaaggatgctaattttaaaattgaattgcttaaatataaatgtataaaataagtaaaagatcaatggactcctcgatgttttgtattatagatgttgttaattgattaacttgtactgagttatttaagagcaaggtagtaagctgttgccaacaactgattcggttgtcacggattagtggccttaaataatttctagccggattacttctctaatcttaacgatttctgatctatttcttaaaaaacgaataaggtctgaatcaagatcagagctggagatgtgcatgggtgcatctcatatggcacaccgcagacaaaagattgcatagttggctccgatcctatttggcaagtgattagagatggcaatggcccaatggttacccgcgatccgatactcgatgagtatttactctattagggtatatatatggtctaaatgttctacctatggatttcttgttaggtaaaaaccttcaaccaattggtaaacgggtataagaaaattctgtccctacccatacttgttaacccgtgggtataaacttagcctaaaaacatgaacttgggctttacttatatatttcttttgacttagcctaaaaacatgaacttgggctttacttatatatctcttttgactatttaacaaccttttcggcgataataccatagaaggcttaacaactatttgatgatcatgtaatagaacatgtaatgtgttatgtgttactatcctagtgttgctactatatccaattatctatggtgttcttgaatagatgattgaatgatgttagaaattttgtaatggatatattgacatttgtataatgtagatgtttaatctttgtgagtacggatctgacgggtaactcatacctatatgggtaatataagtgacccgatgggactattttttttatcttaggtatggatatgagatagataagagatcataatgctcatgtacgccatcaatgccatttttttaaatgaacaacatttgaagccttttccatgagaaagagaaaggggaactaagatatttatagaagttccttagagcaacttcaataggaaccctaatcacataaacaaattaaaatatagagctttaataagaaaagacagctacccaagagccttattttaatgaaattcgtgtaaacttgaagggtagcatatttggatctgagatccgcagccctatatggttcgcgctcgtcccaaccacctcggatattttcgctttcttcttcgccgccaccggctcccattccaccgccaaggtcagcttcgtttccatcgccgcatcgcgttcgcgtgtgccaaccccgctcccatctcaactgtcaccgtccgaagaactgatccgttctgcacaaccgctcgtcactctccaaatttgctgcacctgccctctccaaagttcttgcactcgtccctctccaaagttcctgcagattcacttctctccaaagttcaggaggatgtgtggtgtgacagcgctacaacaaatctgtcaacggggactctcatcctcttgctcatagaaagaactgcagtgttacaggtaggtaattactagagtactactactaagtaaatctgtcaaaggcagtcatggcatccatatccttcacatcagtactgggagtggcacacgcaccgcacacatactactacatctactagtatgtagtggagtgcttgaaaggcataagcgaattttcttcttgtttggtctacgtccatttgcttgtccactaaccggctagtttactctgctttttgggttttccacgtctctacaattgtgactgttagagcaactccagtagttctctaaaaaatagcttgctaaaatcatgtttagcaagttgctaaatagctattggaagtaaaaaataacttagtttccaatagttgctcatatttaggaagtagttcgattttgaatctagctttagcggccctgtccctatgagatctgcctgataataaggttgagagcagaggatatgagggcggaagaaaaaaggtcggtcgatatgaattatggatgagtggtggtccggtgacgcaacttatgagaaagttaggttcgacggtgaaggagaaacttgcgtcatacgtgtttgacctagctacctcattatgctagaaaataaaaaagagtgtgttataactggctatctcactgtataggaaaggtaaaaataatcacgctagtgtgaagaaattgacgtcaactgtatttagggagttcctaccgagttgctaaatgtggagagtaaatagagttgaatagcaactaactaaatttagcaagtctatttagagaaccattggagaagtatttttctgttcacttcttaaatttaagatttagagagttatttagagaactattgaagttgctcttagaccacctataattgtgactgttgaccacctatagatgcggttcaactagccctccgaccccctctcgagagttccgctccaccgcggcgaaggaagtggcggaggaggaggatccgcgcctgcgctgggccttcgtgcggaaggtgtacgcggccccccgctgccgtctggcccacgtacatcgccatcctcctatccctgtccccgctcggactcttcctcgctaccgccgtgtctgcggatctggccaagtagcccggtaggaagcgccgtgggaggagacaggcgaggcgttcgaccgccgccggcagcttaggacgtaccacgtctctgttctatgggttcacgagtttcggggccctacatggattctccgcctccgcctccgcctcgtccgccatcgccgccgcgacaccctcctcaccctcagggcgagcgtcacgtcggcggggagatgctgtaccaggacacagaccataggctccgcgcgctggtcgggagcgccgagggcttcggccgccacgccatcgggggcctctacggggccatccaccgcgtcacgtcgctccaaggtacgttacgtacggcaaggagttagatcgtgcccagcgcttcctgatcctttgattcctgaatgaatcggcgcagacgacgggcccgggagtctgagggaggcgtgccgggcggaggagcccctgtggatcgtcttcgaggtgtccggcaccatccacctccactcctacctccgcgtctcctcgtacaagaccatcgacgggcgcggccagcgcgtggtgctcaccggcaaggggctccggctcaagtcatgccatcacgtcatcatctgcaacctggtgttagaaggaggccgtgggcacgacgtggatggcatccaggtcaagcccgactccaccaacatctggatcgaccgctgcaccctcgccgactacgatgacggcctcatcgacatcacgcgccagagcacagacatcacagtctcaaggtcttttcactcttccttcccctgtaaatcttattactatattgcaaaaaaaaaaactgctatccgatgcggaaattttgtagtaatcgatatattagcttcacgattgaaccaaccaattaacaaattactgcacgcagatgccattttatgcggcacgacaagacgatgctcatcggtgccgaccccacgcacgtcggcgaccgctgcatcagggtcaccatccaccactgcttcttcgacggcacgcgacagaggcacccccgcctccgcttcggaaaggttcacctctacaacaactacacgcgcagctggggcatctacgccgtctgcgcaggcgtagaggcccagatcgtgtcccagtgcaacatctacgaggcaggtggagggcccccaaagaagacaactgtattcaagtacatgccggagaaggccggcgaccgagaggacgtggtggcagggtcgatcagctcggaaggggacgccttcctcaatggcgcgctgccctgcctgatcgataaccctgggtctgtcttcaggccagaggagtactaccagcagtggaccatggagccagcgtcgccggcgctcaaggacataatacagctctgcgcaggatggcagccggtgccccgccccccggatgatcgctgactttcatcattctgatatgctgcagctcgcttctgtaagaatattcgtttcacggaagcactgcatttgtatgcatctcatcctaggtaattcaacatttgtttcatggtagagtggcatttgtatgccactcctcttcatctgccccctctctgaaatgtagtagaaaagttgttatggttttctatttgtgtctttatttatggtacatacaattcccaatgtaaagatatttctctcgtccatagcagtacaatagcttttagttgtgaatgcta

SEQ ID NO: 287 - DNA, 6396 bp, Zea Mays; identical to SEQ ID NO: 286

SEQ ID NO: 288 - DNA, 1813 bp, Zea Mays
gagagttccgctccaccgcggcgaaggaagtggcggaggaggaggatccgcgcctgcgctgggccttcgtgcggaaggtgtacgcggccccccgctgccgtctggcccacgtacatcgccatcctcctatccctgtccccgctcggactcttcctcgctaccgccgtgtctgcggatctggccaagtagcccggtaggaagcgccgtgggaggagacaggcgaggcgttcgaccgccgccggcagcttaggacgtaccacgtctctgttctatgggttcacgagtttcggggccctacatggattctccgcctccgcctccgcctcgtccgccatcgccgccgcgacaccctcctcaccctcagggcgagcgtcacgtcggcggggagatgctgtaccaggacacagaccataggctccgcgcgctggtcgggagcgccgagggcttcggccgccacgccatcgggggcctctacggggccatccaccgcgtcacgtcgctccaaggtacgttacgtacggcaaggagttagatcgtgcccagcgcttcctgatcctttgattcctgaatgaatcggcgcagacgacgggcccgggagtctgagggaggcgtgccgggcggaggagcccctgtggatcgtcttcgaggtgtccggcaccatccacctccactcctacctccgcgtctcctcgtacaagaccatcgacgggcgcggccagcgcgtggtgctcaccggcaaggggctccggctcaagtcatgccatcacgtcatcatctgcaacctggtgttagaaggaggccgtgggcacgacgtggatggcatccaggtcaagcccgactccaccaacatctggatcgaccgctgcaccctcgccgactacgatgacggcctcatcgacatcacgcgccagagcacagacatcacagtctcaaggtcttttcactcttccttcccctgtaaatcttattactatattgcaaaaaaaaaaactgctatccgatgcggaaattttgtagtaatcgatatattagcttcacgattgaaccaaccaattaacaaattactgcacgcagatgccattttatgcggcacgacaagacgatgctcatcggtgccgaccccacgcacgtcggcgaccgctgcatcagggtcaccatccaccactgcttcttcgacggcacgcgacagaggcacccccgcctccgcttcggaaaggttcacctctacaacaactacacgcgcagctggggcatctacgccgtctgcgcaggcgtagaggcccagatcgtgtcccagtgcaacatctacgaggcaggtggagggcccccaaagaagacaactgtattcaagtacatgccggagaaggccggcgaccgagaggacgtggtggcagggtcgatcagctcggaaggggacgccttcctcaatggcgcgctgccctgcctgatcgataaccctgggtctgtcttcaggccagaggagtactaccagcagtggaccatggagccagcgtcgccggcgctcaaggacataatacagctctgcgcaggatggcagccggtgccccgccccccggatgatcgctgactttcatcattctgatatgctgcagctcgcttctgtaagaatattcgtttcacggaagcactgcatttgtatgcatctcatcctaggtaattcaacatttgtttcatggtagagtggcatttgtatgccactcctcttcatctgccccctctctgaaatgtagtagaaaagttgttatggttttctatttgtgtctttatttatggtacatacaattcccaatgt

SEQ ID NO: 289 - DNA, 1063 bp, Zea Mays
accctactccatcttctcgtgttgttcggcgcacgcggagacagcccgcgatcccgatcccgatccttcttcacgcgaatctcgacgatcccccccttccttccttcaaggtacggcgaatcggcgatcatcctcccgctttcccttctcctctaggtataatgatttgttataggttatggggacttttgagtcatcgggtcgatctgacgatttgctatgggtgctctgagtactcgacctgggaactgtggggcgcttgtaggcggcgcagagttgggtctcgtcgttgtaatgattccatcggctcgttgcgtagggtttgatctgcctgtcgttttcttttcttttaattaaatttctgatgcacagtcatgtattgatctggtttggtgttcctagatgcgtgtaataaatggggaaaaaaccatgtcgtaataaaatcaatttatttttaataaaaaaaatctgaattctggctctagtgaataaatggatagagcctggctctaattctggtaaaataaaaagacaacgagcttaacttcttaattggtcaattggaagggttctccgatctaattagacgttgaaaatatattgcaagattacttcacttctttaaattgccaagaaaccataaatttaccattgtgattggggctacttttttttaacctttagcctttgtgaaatttaaccgaatctgttcattttggtatttgagtgtttttaatggattagaaattctttcttttcatgtcttaccaattcagtggtgtaatttcatctagattctgatcgtatctaagagatcctagttctgtcgtttttttaacatccagaaggagagcaccctccacctggtgctccgcctgaggggtggcaatggtaatgcagatctttgtgaagaccttgactgccatgtatgataccgtctttgaagtatttgtattgtctgtcgtgactaagtttgtttcgtggaccggttgtcttctaccctacccaaaactacagtgtggcagcaaatgatgaataaatgtgatgtttgaatttaaaaata

SEQ ID NO: 290 - DNA, 700 bp, Zea Mays; identical to SEQ ID NO: 115

SEQ ID NO: 291 - DNA, 5223 bp, Zea Mays
agaaagattcgcccatcgcccactggccactgcgcactgggcacggactggcaggcgaagaacctaagcagaacctaccatgtcaccggcggcgaggcgcatcctgctcgccgtcgccgcccgtcgccgccgcttctccacggacgcagcggcgtcggacccgtcccgggcgtcgcagcagctgcccaggggcaagcgatgggatgcggtggtgatcggcggcggccacaacggcctcgtcgcggccgcctacctcgcccgcgctggccgctccgtcgccgtgctggagcgccggggcgtcctgggtggcgcggcggtctcggagtcggaccttgtccccggattccgcttctcccgctgcagctacctcctcagcctccttcgccccgccatcctccggtgagtaaactcctccaaggatgcgtcctttgcgattagcaagcctcggttcctgttaaattcatgcgccgcagatcaatgtcggtcattctcctctgtacacaactctgaactgcataccgttgttttgatttgtatctggtgctgatgacactgctgctgttgttgtgggtgcttcatgcttgcacatattctgtaatataagcgacctggagctggagaggcacgggctgaagctgctgccgcggagcccttcgtcgtttacgccatgccttgacggcagatacctgcttcttggccccgatgctgagctaaactactcagagatcagcaagttctctaggaaggatgcagtggcatacccaaggtgcagtttatcttggaatgatcttagattaaataaacgtttaagttcctgattcctgtggtatctatgtacattttagctctttattacaatggtcttggtaggatctgtatgtgaatgcagatacgaggagaagctggagaacttctgcaagctcatggactttgtcatagactcagctccacccgagctgaggcaggaggcccacttctcgatggttgacaggatgaagcatagggttgagaagtcagcattctggggccaccttcttcggcatgtgatgcagcaggggcagaagaacatggtgtgagtatcaaatactggccatgtttcgataggcaccgtttatgcaaccctttctaaaaatcaaattgttgtgcagggaattctttgacctactcctttctccggcatcgaaaatcttgaacacctggtttgaggtcagcattagtcccatcttaaacgcttctgttcacattgatctctgtggttgctttatttcaattggcagccttcacctaatcttatttaatctgtgaacaaaagggcctcccattgactactgtctactgcagagtgaggttttgaaggccactcttgcaactgacgccgtgataggagctatggtgagggcactttgaatggaataagcaaaatattttgcctagcacgttggcatttaactgctggatatcccttttataggctggtgtgcacactccaggttctggatatgttcttctacaccatgtcatgggggagactggtggtcagcgtggtgtttgggcgtatgcttcttgctttgactctctaagacgcctcttatttttgttaaattttcagtagagactttgattctaaatgtttcatcaactggtgtgaatatccactggatgggcaagcaagttttcaaggactagtgttataggaaatggcatcatactatgctgtcaaatctgcttgttagtatgttaggtttattattagttctttcgcccgttcatatttgtttcagttgttcggaaaacttcttgtttaattaaagaaaataatacacttgctacaggtatgtccaaggtggtatgggttcagtgtcatcagctataagcaaagcagctcttgaagcaggagtgcagattgtaacaaatgccgaggtgacttcacaattcttatagcatgtacggctgctctttggcagagtttttttttccaaactgaaacggaaaaaaacaatcaattattcaaatttgtgaactggagttctcaaaggaaaagacccatttgttttatgtagtggcagtttttcataattgtggtttacgttccatattaggtttgttccttgacttgatcctttgttttgtttaggtttcccaagtaatggttaatgaaactagtggaatggtagaaggggtaagtactttgaataacctgtaagttcatttaattgctttcaacctcttgaggtcttgttcggttaggggtggattgagggggattggaggggattaaatccccttctatacaaatttgaataggagatgatttaatcccctccaatccccctcaatgcacctcaaaccgaacaagccctgaaagattgggatctgtaggtagctttggttgatggaacagaggtgcactcgccagttgttctctcaaatgccacaccatacaaaacatttgtggtaaggaaaactcagaaatatgtaatgttgcaaagatctaccagctctagtgttgctagaataactaagcaaatatcttttatgctgatatctggtttcttttgcaggacctagtaccttctagtgttcttccggaggacttcctctgtgcaattaaggcagcagattacagctctgtaagaacttgtgtacaagcatatttcagtacaataataatggtgtttttttcaaacaaagaaattgcatctaacaaatagtcactgagttgaaaagcatcatcataactcatttacaccaacatgcctgtctgtgacatctgtgctgagttggttaggcggcaccgtagcctatgtgagaacgaccatgattaggagcaggccttagacgtgttttgacatgggatagactgtagatgtgaggattttttaactctagcctaaaattcgctcccattggaagttgaacgatggacctaaggagtgctaatcaaaccacctaaccaattcagctatctcagcttgaggccctttcccttctttggtaaaatatatatttatattttataattgcttcttagatgaatagtttgaacattctgataatcaacagtgactccaacacctgaaatattatagctctaacctcaataatataatataatatgattttttttggggggcaggcaacaacaaagattaatgtggctgtcgacagactgccacagttccagtgttgcaacaccaatcttgaaggtggcccagagcacatgggcacaatacacattgggtccgaaaggtatacagagatgacatatttttcatattgagttcgtctttgatctttatttgcagatatcagataaacaaacaaggtgtcagatacaatttgttgtcacatttatcatttttgttaatgtattgtgcatcttccctcgccctagagagaacttttttttatgtattgcactgcctgtgcttgtcaacattagtgggacaagggaaatggtctcttaacccaagaatgttattagttattactcgataataagttgtggtgtcctgaaacagtgccctgaatcctgacttaaattacaaaacttgttaacctacaagtgtaaattgatgtaattatgttcttttcatctgtatcctgggataataaataaaatggccatgctaaccgcaagtccgcaaccatgttatatgggaccagactgtagatagattttcattcctcattcttttaccagaaggaaagccagattgatccggcctctcgtgtgattgtgtgaaaaactatttatttgagaagaaaaatagcatcaccttgactgagctattccacacttaatgtcttctaatatggaaattatgctctctttccagcatggaggaaattgacgttgcatacagggaagcagcagacggcatctcgtccaaaagacctgttatagaaatgacaattccttctgttttggataagaccatctctccgccaggtatgcatgtatcttgctccgtcatcgcagtggcataactatctactaagacatatctcagtatcacaagatcccaatagagcaagaaactatatgggggcgcacgtcgttaaactgtgataggatcctaccgctactctttgtgtccaaggcaatttttcgttcctacccccctgatatcatttccatcttttgctttatcctttcgataggtcagcatgttattaatctctttgttcagtacacaccctacaaactttcagaaggcagctggcaggattctaatgtcagagtatgttgatcttgctcacgctttgatctcgctatacatttcgcgtccagcgcctgcacacgcagagatggctcacaaatattgttaggcgttgctgctaacaccatccgcggatagatttgcttgctggatttggcatcggtaaccattttttatggaaactcattttcagaaagcctttgctgagcgatgcttctctttgattgatgagtacgcgccaggcttcagctcatcggtggtaggctacgatatgctgactccgcctgatcttgaaagagagttcggcctaacaggtagatctctttcctctcgatgtttttcatttcactgtacctgttgaagagcttagcgcgctaagaaaaacacggttcacatttcacagggggaaacattttccacggcgcaatgggcttggattctctcttcctcatgaggcctgccaagggatggtaatgtttgccctattgcattgatccttttttcctccttttgccgatctttgaagctttccatgtcggaggaatccgtggctctggggtcatgactactagcatgtctgcgctttggagcgcacaggtcggattacagaactcctgtgaaggggctgtacctctgcgggagtggcgcacacccaggtggcggggtgatgggcgcgccaggacgcaacgccgccgccgttgttttggaggaccacgtgaagacaaagtaggtgtagtgtagctcgctggaaaccaagatggcatttttatcatcaggagaaaatctttgatgccatggtgctgttttagtgcctttcttttcttttcctttttggagaattattgtcgcaatccatagtcggagaacttatatcatgtgaagactcgtgtaacaaatcctcactaacatttctgtccctgtccggcgggaaattggaactgtggtaaaatgtggacccatctctttgaaccacaaaggccctatgggcttattttgtgat

SEQ ID NO: 292 - DNA, 2711 bp, Zea Mays
gatctaccagctctagtgttgctagaataactaagcaaatatcttttatgctgatatctggtttcttttgcaggacctagtaccttctagtgttcttccggaggacttcctctgtgcaattaaggcagcagattacagctctgtaagaacttgtgtacaagcatatttcagtacaataataatggtgtttttttcaaacaaagaaattgcatctaacaaatagtcactgagttgaaaagcatcatcataactcatttacaccaacatgcctgtctgtgacatctgtgctgagttggttaggcggcaccgtagcctatgtgagaacgaccatgattaggagcaggccttagacgtgttttgacatgggatagactgtagatgtgaggattttttaactctagcctaaaattcgctcccattggaagttgaacgatggacctaaggagtgctaatcaaaccacctaaccaattcagctatctcagcttgaggccctttcccttctttggtaaaatatatatttatattttataattgcttcttagatgaatagtttgaacattctgataatcaacagtgactccaacacctgaaatattatagctctaacctcaataatataatataatatgattttttttggggggcaggcaacaacaaagattaatgtggctgtcgacagactgccacagttccagtgttgcaacaccaatcttgaaggtggcccagagcacatgggcacaatacacattgggtccgaaaggtatacagagatgacatatttttcatattgagttcgtctttgatctttatttgcagatatcagataaacaaacaaggtgtcagatacaatttgttgtcacatttatcatttttgttaatgtattgtgcatcttccctcgccctagagagaacttttttttatgtattgcactgcctgtgcttgtcaacattagtgggacaagggaaatggtctcttaacccaagaatgttattagttattactcgataataagttgtggtgtcctgaaacagtgccctgaatcctgacttaaattacaaaacttgttaacctacaagtgtaaattgatgtaattatgttcttttcatctgtatcctgggataataaataaaatggccatgctaaccgcaagtccgcaaccatgttatatgggaccagactgtagatagattttcattcctcattcttttaccagaaggaaagccagattgatccggcctctcgtgtgattgtgtgaaaaactatttatttgagaagaaaaatagcatcaccttgactgagctattccacacttaatgtcttctaatatggaaattatgctctctttccagcatggaggaaattgacgttgcatacagggaagcagcagacggcatctcgtccaaaagacctgttatagaaatgacaattccttctgttttggataagaccatctctccgccaggtatgcatgtatcttgctccgtcatcgcagtggcataactatctactaagacatatctcagtatcacaagatcccaatagagcaagaaactatatgggggcgcacgtcgttaaactgtgataggatcctaccgctactctttgtgtccaaggcaatttttcgttcctacccccctgatatcatttccatcttttgctttatcctttcgataggtcagcatgttattaatctctttgttcagtacacaccctacaaactttcagaaggcagctggcaggattctaatgtcagagtatgttgatcttgctcacgctttgatctcgctatacatttcgcgtccagcgcctgcacacgcagagatggctcacaaatattgttaggcgttgctgctaacaccatccgcggatagatttgcttgctggatttggcatcggtaaccattttttatggaaactcattttcagaaagcctttgctgagcgatgcttctctttgattgatgagtacgcgccaggcttcagctcatcggtggtaggctacgatatgctgactccgcctgatcttgaaagagagttcggcctaacaggtagatctctttcctctcgatgtttttcatttcactgtacctgttgaagagcttagcgcgctaagaaaaacacggttcacatttcacagggggaaacattttccacggcgcaatgggcttggattctctcttcctcatgaggcctgccaagggatggtaatgtttgccctattgcattgatccttttttcctccttttgccgatctttgaagctttccatgtcggaggaatccgtggctctggggtcatgactactagcatgtctgcgctttggagcgcacaggtcggattacagaactcctgtgaaggggctgtacctctgcgggagtggcgcacacccaggtggcggggtgatgggcgcgccaggacgcaacgccgccgccgttgttttggaggaccacgtgaagacaaagtaggtgtagtgtagctcgctggaaaccaagatggcatttttatcatcaggagaaaatctttgatgccatggtgctgttttagtgcctttcttttcttttcctttttggagaattattgtcgcaatccatagtcggagaacttatatcatgtgaagactcgtgtaacaaatcctcactaacatttctgtccctgtccggcgggaaattggaactgtggtaaaatgtggacccatctctttgaaccacaaa

SEQ ID NO: 293 - DNA, 926 bp, Zea Mays; identical to SEQ ID NO: 118

SEQ ID NO: 294 - DNA, 1248 bp, Zea Mays
cacaagagcaagagcaagagcaattactgcaaaaccctaaattagctacgtatagcttctcttctcacccatggccaattcaagcaactacggccttgggcttgcttgcttcttcgccattgctgctgcggtcgccggcgggacgcagttcatggtcggcggcgccaatggctggagcgtgcccaccgccggcgccgagcccttcaacacttgggcggagaggacgaggtttcagatcggagactccctaggcaagtaatctcagattgatgtccaaatgcatccaacactgtgtgtctgtgtgtgatgtacgccatcgccatgcatgatgctgatgcctgctgccatttcttgtgtgcccatagtgttcgtgtaccccaaggaccaggactcggtgctgctggtggagccggcggactacaacgcctgcgacacgtcgtcgtacgtgaggaagttcgacgacggcgacaccgtggtcacgctcgaccgctccggcccgctcttcttcatcagcggcgtcgaggccaactgccgcgccaacgagaagctcatcgtcatggtcctcgccgcccgcagcaacggcaacggcaccggcggcggcgcgcaggctccgagcacggcgccgcagccggcgtcaccggcggcatcgccccctcccgccagctccaccccgcccccgccgtcgtcgcccgctcccaagggcgcgtcgccgcccccggcctctgctcccacaacgacaccgggtacgccgccgccccctgctccgagcgcgtcgtcgcctgctccggcgtcgtcaaccccaccgccgccatctgccccgcaggcaccgccgccgccccctgcttcgagcgcgtcgtcgcctgctccggcattgacgaccccgccgccgccatctgccacggcgaatgccccgcaggcaccgccgccgccctcggcgagctctccgtctccgagcgcacatggagcaacggctagctcgacgggcacgccatcgtcgcctcccgccggcgccgaggtcaagaacggcgccgccctcacggtggccacgggcttggccagctccttcggggcctgcatccttggctacgccatgcttgctctatgaagaagtgaagtggaccgtggacacgatgcacggaagacccgagtaaatacagtatgtctatacatgttaactgaagacatgcgatttgtgcatgctttcgttttccgccgcatgaataagaaatcaacaattctttatgcctc

SEQ ID NO: 295 - DNA, 998 bp, Zea Mays
atgcaggccccgaaggagctggccaagcccgtggccaccgtgagggcggcgccgttcttgacctcggcgccggcgggaggcgacgatggcgtgcccgtcgagctagccgttgctccatgtgcgctcggagacggagagctcgccgagggcggcggcggtgcctgcggggcattcgccgtggcagatggcggcggcggggtcgtcaatgccggagcaggcgacgacgcgctcgaagcagggggcggcggcggtgcctgcggggcagatggcggcggtggggttgacgacgccggagcaggcgacgacgcgctcggagcagggggcggcggcgtacccggtgtcgttgtgggagcagaggccgggggcggcgacgcgcccttgggagcgggcgacgacggcgggggcggggtggagctggcgggagggggcgatgccgccggtgacgccggctgcggcgccgtgctcggagcctgcgcgccgccgccggtgccgttgccgttgctgcgggcggcgaggaccatgacgatgagcttctcgttggcgcggcagttggcctcgacgccgctgatgaagaagagcgggccggagcggtcgagcgtgaccacggtgtcgccgtcgtcgaacttcctcacgtacgacgacgtgtcgcaggcgttgtagtccgccggctccaccagcagcaccgagtcctggtccttggggtacacgaacactatgggcacacaagaaatggcagcaggcatcagcatcatgcatggcgatggcgtacatcacacacagacacacagtgttggatgcatttggacatcaatctgagattacttgcctagggagtctccgatctgaaacctcgtcctctccgcccaagtgttgaagggctcggcgccggcggtgggcacgctccagccattggcgccgccgaccatgaactgcgtcccgccggcgaccgcagcagcaatggcgaagaagcaagcaagcccaaggccgtagttgcttga

SEQ ID NO: 296 - DNA, 1419 bp, Zea Mays
cttttcttcagtatgaacattcaggagatatgtgtatccttgtcattcatgcaaattgtatccctgttgtctccttttcccttccccacgttttagtgtatctttttgtagcatgaaagccaagaccttttctttgtgctccaagaacatttgagcttattccacattcttgcaggagctctttctcttccgtcaaagggttccaccgatggcgataaagatgaaggggatcttcaaagggctgaagataatttctcaaatgtttggtaacagcccccatccatccatccttctatattcttattttgtttctgcattttttgcattacttggcttaaagttcctgtgaattggtttctacacccgcattctacagatttctataataaaatgcatgaaaaaaaagtaagtacctatatataaatcagtaccaacctaaaagcatatggtgaaagcacaagtacctgactagacatctgatcttctgcagcgcataaggagcaggagatggagattgggtaccctacagatgtaaagcatgtggctcacattggtctgggcaccagtgacacatctccaagctgggtaagaatatcacaacaataaaataagcagcattatgctttatttgttgtcatgagtttacacattgttcacatagttctttaactgatggtggtgtaccgtttttttttacttttagatggctgaattcaagggaacagatgattcatcagcaggctctgtgagcacagctgcgcagtcaaggcagacttcttgggcctctgcaggtgattctcacctctgcgctgacattgctttgcttgcccttcaaaaatattcattcaaggcaaaaaaagaacagactaattaaatggcataatcagtcataaagataagtaaaattgatgtcatatgacattccagccacgcccttaaacgaatctatgcctcatttgcgcttatgattaggcgcctgaatcttctcaccctatttcataatgaaattagtggcacaccactaactacacgtctgctctataccaaggactgggcctcttgcctcttggtcgcttgcatgtatgcaagttgccctgagcaaaaaccactgcagaaatctgtcagacgaccctccgatccctgagctgaaatttttactgaattttttaattcgttgcagacttcgagcagccgagaagcatgctgcccatcgacatcttccaggacaagaggcccgggcaagagaacccggacgtgcagaggggggagagaaaggcgaggaggaagaagacgaagaagaacagagcgtcgtcgccgcccgcttcgtccgcaaggtcgtcttccgcgaggtccacagcctcgtttgcgacggcgtacgacgccttcagcgagtcccagagagggttcccggtcgcctga

SEQ ID NO: 297 - DNA, 1890 bp, Zea Mays; identical to SEQ ID NO: 122

SEQ ID NO: 298 - DNA, 521 bp, Zea Mays
gacgacagcggaggcgttcccatggcgacgtggcaggtcatcgtcgccgtggtcgaaggaacgcggctggcgccagacaccgctgacttggaggtaggtagaccgaccacccgagctgcatccacgttcgttgccctagctaggctattagcagctcagcagccacactccggttactgcagaccagcagcagcaccgcagccacgcagcagacggactccacggagaagacggcgctggccgtggccgcaacagccgccgtcgacctgaccaacctgttcttcctcctccgcggcgacaccgacaccgacgccgagcggcgacggcgctggggctggaccgggggaatctgcgtgctgttcgcgttcgcggctctcctttccgccgccggcaccgtgctcgctccgcacgtcgtgtccgcggcgcgccggcgggtcctcttggtggcttccgcggcggcgctgttcgtggcgtcggccggcacagtcctcgtcctgctgttggtggagctggacgcgtaa

SEQ ID NO: 299 - DNA, 466 bp, Zea Mays; identical to SEQ ID NO: 124

SEQ ID NO: 300 - DNA, 874 bp, Zea Mays
gagaagaacaggtggttcaggaggagcctcaaagcgagaagtatgatctgatctaggtggcgtttccccagttgacttttgcgccaaggatgattcttagttcgttttataatttattttgtaagtattccgctatgtaataagtactctgattatattgtgacatttatctctatacactctgttattatatatgttgtcttctttggcgcatgtatgagatgcacccagctttgtcccttaaagcccgggtgttacactactgctgctgccaaggacttaaaagtttcctctgctatgactggaaggtaccgcaagtcatggacatcctcgctccaaggagtagaaagtaaacagggatgtacatgtcgaaggtagggaggaagactccaaggtgaactactcagacggaagcgtactcgacgataaggcaccggacgctcgcaagactcaaccccctcatggtctgatcaaacatgacaaaatggaggcacacatggtaacatatcagaaagcaccacacttccaagggtggaaatggtgtactccatcaaatctttatgtaattagtgaccactcgttcaattcctccgactatataaagggatgagggttgagctataggagtagggaaacttagttgataacattgttgtaaactatggtgacgtctaagagggggtgaattcggacttctaaaaatttcgctctaaattaggccacaaataaatccctagaacaaaacatattcaaatatgtaaactagattgtgcaaactaggtgttgactaaatgttgctatctctattgcaaaaggagtttcgcaacaagttacaatcattaatattctaactacaaatgagagattgaaactt

SEQ ID NO: 301 - DNA, 477 bp, Zea Mays; identical to SEQ ID NO: 126

SEQ ID NO: 302 - DNA, 3630 bp, Zea Mays
ctctccctctccctcctttcttctcagcttgctggccatgagaccgctctcctcaacccaccatatttatctgcctcctctcgccacatgctctcctcctctgccggctcagtcgtgggacgagttccgatcccgacccctagcttccgctcccgatccgtcgtctcatcctctcctacttgctggtacgctctctcgccatgcgctgcgcctccactgatcaaatccgtcgaccgcctttgtggttcttgcaatcttgcatgcaagtttctaaaagctttctgtgatctcgctcttcttgcttcctcctcttgcatatcgtacactgggtctgcatgcatccgtgtcaccaccatattctatgcccagcccacggcttgcactgtttgctagtctactcctgcgcataccatctactgttccttcagtcgatcgatcgatcgtgctttattcgtgcggtactcaacttcaaaaggcagtcacgcacgcacacatagattactgctagtccgctgaccagccatgttggtttgggtttaatccatacgacttctactatttttgtttttacagtgtttttatgtctataaattgcagctgcatcaatttaaacagtcggttttaatctaaaaccaatagataaaggaccctgctccataaattggggcggcgacactcgtttcagggcttgggggatcgatttcaattcgccatttccatctggaaactagggagggtaatggatcaaattttaatttaaaaatgaataaaaatataacgtgatgtcttgatatcatccttaaattttatataatctaaaactttttagagtctattaccactcgctaggtgcgttctacagttctccggctttttgatctatccagccagccacaccaaacaagagagcagcccgagctccttggaaaatggcgaagtgtgctgtagatgtggaggacacccgtccaaataataataataataatgcacaacacgttcaaaaatattttttaaaatgtaactaaatttatagaaaatagtattaaaatttatgtttttaaataaattatgttataaaaatatattttgtcaccaaattagcgataactattacaatttataattatatcagtattgttttttatttatatataataaatctagaaaaatgtgacttctacatgtacacagacgctgcctgcaggaagagtgttctagtgtcgcctctgttcgtcgagcaccaaccttgcacttctgtagctcggctcactagtgattgagtcgattaaagtttgcagttttgctttgcttccttccgttctccgcattttccttgtgcgttttttctttaacttcaatgtgcgtcagttcgttcttgcatgtctgctgtctgctacggatcagctctagatcatcaaactgtgctagtcaattccagatagagagagtaggagtaggtatatcgctacagagtgcaggcatacaggttggtgtggcagctagctgagtctagcctgaaaccctagctagttcatcgaggattctgaattcctggtccgtcccagctccgtcgccccggccggccaagaatagatgaagcgactgatccgaccagctctttgctccttgcattattcgtcctttttattatacgtatagtataaccatagccaaatcgtttcactatccaaccaggcatgcgtcgtgcagatctggtcgagctcgtgttcgcgcttcgcggagatcgtcaggtgaccgagcgagccatggaggtagccggcgtcgtcgcgtccgcggccgacagccctggcgccgcggcggcgcggccgagccggtacgagtcgcagaagcggcgggactggcacacgttcgggcagtacctgcgcaaccaccggccgccgctggagctggcccggtgcagcggcgcgcacgtgctggagttcctgcgctacctggaccagttcggcaagaccaaggtgcacgcggcgcggtgccccttcttcggccacccgtccccgccggcgccctgcccgtgcccgctcaagcaggcgtggggcagcctggacgcgctcgtcggccgcctgcgcgccgcgttcgaggagcacgggggccggcccgaggccaaccccttcggcgcgcgcgccgtcaggctttacctccgcgaggtccgcgacagccaggccaaggcgcgcggcatcgcctacgagaagaagcgccgcaagcgccacccgccggcgcaccgccagcccaagcagcagcagcagcaggacggccagcaccagcacccgtcgcacgccgcgccgggcacggtggccgagccgccggcgccgcacttcttgatcccgcacgcgcacttcctccatggccatttcctggcgccggcgaccgagcccatcgacccggccgcgggcggaggtggcggcactggggatgatattgcgctggcaatggcagccgccgccgaggcgcacgcggccgggttcttgatgccgctgtccgtgttcaactagctagcttgcttgcttgcaccagtacttcttccaccgttccatcggcttaattagcagaaatgcaagagtgattaggcacgtaagtaaacttgcaggttctgctaatggcgaccgatttggtctcggcgtgcgcgcgcgatctaagtatgagatgacactggctgtgtgccccatcatcaaccgctgctactgcctgtctgcctgccagccttttggttgtactagtgattttgcatggtcttgtgtatgcagtgatccatagaatggcaggattagatggcttgttcattctccctggcgacgttcttcttggggatttcatgtggtgtaaggctatctccagaaaaccgtatatatatgaacatgcaaagtaatgctttgcattgaaatagagagtaagatatggcgcaagtagagcacaagcacaacacacaaacgatttatctaatggttcagtttgtgactaaggcttgtaccaccacattgttgagaaagccaccaaggctagagttgtgggagattacaaacggcttaaagtaactacaagagcatggtgcttcaatgagatacaactagttggctagcagctcttgctccaagagtaatagatagaaaccactagcctgagcacaatccaagtgctccacgaggagttaggctggctccaacaaggccctctaaagggttctctaccctaaatatagaggaccaaacggtcctctacgctctccagcaacgtcctctaaacggtcctgtaaatttagaggacgctgctggattctctatatatagagtttctctaaacgatcctctattcatttgactactttaaataaccagtttagcaaaattaaaatatgtacaatatatttgagagtatgataaatacgtatgtacaaaaaataaaattaaaaaatgtttttaatatgggtatttgagtatagaggacgtgatttagaggacgttgttggagagaaatgagatatagaggataaaatcttttagagaagactgtaaaggacagatatagaggatgaatatagaggacgttgctggagacagccttatatctcaggatgaacaactctctaatgaagatttgcatgccaagatttctcgg

SEQ ID NO: 303 - DNA, 3628 bp, Zea Mays
ctccctctccctcctttcttctcagcttgctggccatgagaccgctctcctcaacccaccatatttatctgcctcctctcgccacatgctctcctcctctgccggctcagtcgtgggacgagttccgatcccgacccctagcttccgctcccgatccgtcgtctcatcctctcctacttgctggtacgctctctcgccatgcgctgcgcctccactgatcaaatccgtcgaccgcctttgtggttcttgcaatcttgcatgcaagtttctaaaagctttctgtgatctcgctcttcttgcttcctcctcttgcatatcgtacactgggtctgcatgcatccgtgtcaccaccatattctatgcccagcccacggcttgcactgtttgctagtctactcctgcgcataccatctactgttccttcagtcgatcgatcgatcgtgctttattcgtgcggtactcaacttcaaaaggcagtcacgcacgcacacatagattactgctagtccgctgaccagccatgttggtttgggtttaatccatacgacttctactatttttgtttttacagtgtttttatgtctataaattgcagctgcatcaatttaaacagtcggttttaatctaaaaccaatagataaaggaccctgctccataaattggggcggcgacactcgtttcagggcttgggggatcgatttcaattcgccatttccatctggaaactagggagggtaatggatcaaattttaatttaaaaatgaataaaaatataacgtgatgtcttgatatcatccttaaattttatataatctaaaactttttagagtctattaccactcgctaggtgcgttctacagttctccggctttttgatctatccagccagccacaccaaacaagagagcagcccgagctccttggaaaatggcgaagtgtgctgtagatgtggaggacacccgtccaaataataataataataatgcacaacacgttcaaaaatattttttaaaatgtaactaaatttatagaaaatagtattaaaatttatgtttttaaataaattatgttataaaaatatattttgtcaccaaattagcgataactattacaatttataattatatcagtattgttttttatttatatataataaatctagaaaaatgtgacttctacatgtacacagacgctgcctgcaggaagagtgttctagtgtcgcctctgttcgtcgagcaccaaccttgcacttctgtagctcggctcactagtgattgagtcgattaaagtttgcagttttgctttgcttccttccgttctccgcattttccttgtgcgttttttctttaacttcaatgtgcgtcagttcgttcttgcatgtctgctgtctgctacggatcagctctagatcatcaaactgtgctagtcaattccagatagagagagtaggagtaggtatatcgctacagagtgcaggcatacaggttggtgtggcagctagctgagtctagcctgaaaccctagctagttcatcgaggattctgaattcctggtccgtcccagctccgtcgccccggccggccaagaatagatgaagcgactgatccgaccagctctttgctccttgcattattcgtcctttttattatacgtatagtataaccatagccaaatcgtttcactatccaaccaggcatgcgtcgtgcagatctggtcgagctcgtgttcgcgcttcgcggagatcgtcaggtgaccgagcgagccatggaggtagccggcgtcgtcgcgtccgcggccgacagccctggcgccgcggcggcgcggccgagccggtacgagtcgcagaagcggcgggactggcacacgttcgggcagtacctgcgcaaccaccggccgccgctggagctggcccggtgcagcggcgcgcacgtgctggagttcctgcgctacctggaccagttcggcaagaccaaggtgcacgcggcgcggtgccccttcttcggccacccgtccccgccggcgccctgcccgtgcccgctcaagcaggcgtggggcagcctggacgcgctcgtcggccgcctgcgcgccgcgttcgaggagcacgggggccggcccgaggccaaccccttcggcgcgcgcgccgtcaggctttacctccgcgaggtccgcgacagccaggccaaggcgcgcggcatcgcctacgagaagaagcgccgcaagcgccacccgccggcgcaccgccagcccaagcagcagcagcagcaggacggccagcaccagcacccgtcgcacgccgcgccgggcacggtggccgagccgccggcgccgcacttcttgatcccgcacgcgcacttcctccatggccatttcctggcgccggcgaccgagcccatcgacccggccgcgggcggaggtggcggcactggggatgatattgcgctggcaatggcagccgccgccgaggcgcacgcggccgggttcttgatgccgctgtccgtgttcaactagctagcttgcttgcttgcaccagtacttcttccaccgttccatcggcttaattagcagaaatgcaagagtgattaggcacgtaagtaaacttgcaggttctgctaatggcgaccgatttggtctcggcgtgcgcgcgcgatctaagtatgagatgacactggctgtgtgccccatcatcaaccgctgctactgcctgtctgcctgccagccttttggttgtactagtgattttgcatggtcttgtgtatgcagtgatccatagaatggcaggattagatggcttgttcattctccctggcgacgttcttcttggggatttcatgtggtgtaaggctatctccagaaaaccgtatatatatgaacatgcaaagtaatgctttgcattgaaatagagagtaagatatggcgcaagtagagcacaagcacaacacacaaacgatttatctaatggttcagtttgtgactaaggcttgtaccaccacattgttgagaaagccaccaaggctagagttgtgggagattacaaacggcttaaagtaactacaagagcatggtgcttcaatgagatacaactagttggctagcagctcttgctccaagagtaatagatagaaaccactagcctgagcacaatccaagtgctccacgaggagttaggctggctccaacaaggccctctaaagggttctctaccctaaatatagaggaccaaacggtcctctacgctctccagcaacgtcctctaaacggtcctgtaaatttagaggacgctgctggattctctatatatagagtttctctaaacgatcctctattcatttgactactttaaataaccagtttagcaaaattaaaatatgtacaatatatttgagagtatgataaatacgtatgtacaaaaaataaaattaaaaaatgtttttaatatgggtatttgagtatagaggacgtgatttagaggacgttgttggagagaaatgagatatagaggataaaatcttttagagaagactgtaaaggacagatatagaggatgaatatagaggacgttgctggagacagccttatatctcaggatgaacaactctctaatgaagatttgcatgccaagatttctcgg

SEQ ID NO: 304 - DNA, 1597 bp, Zea Mays; identical to SEQ ID NO: 129

SEQ ID NO: 305 - DNA, 3229 bp, Zea Mays
aaagcacacgcacaccaaactaccaaaccaacagagcaacatcaatgcgccttccgccgccatcaaccaccgcggccgcagccgctgccaccgtcggggccgtactcgccgcagtcgccctccgccgctacctgtccgcttctcgccaccgcgaacccgcccgcgtgcccatgtccgcggccgccggagccaccacgcttgtggtgtacggcaaatcggcgcaggagcaggagctgctggcctccgcggccggttccgtcgtcctcggtgagggcgatccgtccggtgatgtcgccatcgcgctcgcctacgagagcgcgggcttcgacgccgccgcgtacatgagcgcgctccgggcgcgccggttcgggaggtggatgctctggacgcccaggattggttccacgcaggatctcatcacgcggtgagtgccatgtctggtttcgcgccggggagggatttgggttttcgttttatcttatttttactttgtttgacttggcgtcagctcgtgttcgcaggaactttgcaaagctaccggtgggcgttgtgtgcgttgccgacgtgcagttcaaagggagaggtgcgcgtgattaggggctggcttgttgctcttagtgttttagtcctgatgaatttgcaactttgattacaaagctctcgaattttatttcaggcgagattgatgctctcttatacttatgatctcattgataaaactgatgaaactatctgctgaatgctgtgtaacctttaagattaagtgcttgaaaaatgcagtctgactgaacacaagtagaatcttactgtagtgtgacaactctttatcaaaataactgttttaattgattctacttttttgtggcaacacattcttaaccagttggctaaaccagatcatacatagcattcccttttttctttcatctttctaatcacataattttagtatgcactaggtgctattaagagataacaaatttaatctttgctcacgtatcatgcaggccgttcaaagaatgtgtgggaatcgccaccaggctgtctcatgttctctttcacatcacagatgcaggatgcacggaagttgccccttatgcaatatgttgtctgcctttcgataactgaagctatcaaggagctgtgccgtgccaaggttaggttatagttcagtgttgtcatgtttgctgcttattgattgcattttgagtcccctgtttcctttatgctaactacctcagttgccatttcattctgcctttgtgataaaactcagggactaccagaacttgatgtgagaataaaatggcctaatgatctctatctgaaaggattaaaagttggtggcattctatgtacctcatcttatgaacccaaagtgtacaatatttgtactggtaaaatgcatttccaatgttgcccattctaagcatttgatctctttttttttttcttttgacaaggatgggattcctttgatcttaatcaggtgttggtttgaatgttgacaatgagaagcctaccacatgcttgaatgctgcacttcaagaggcaaatcatacatcacccatattgaaacgagaagacatattggcatacttcttcaataaatttgaaaaccttttcgagatcttcatgaaccatggtactcggattccatttccccccatttttgcagtacataaccacatgctcattagaaccgtggctgttgatgtgtatgcagagctggttcctttactgacaatgcattaaatgataattttgttttgctgtagagacttactgttttcctatagctgatttagatgctgacaaaaaatgttttgaagttaactacaatttttttgaactctagtctacccctaaaaggcttttgtttgtttgttgtttttgtctagcctaccccaaatttcttgggactaaaaggctttgttgctgttggtagaattgtgtacttaacatcctcaaatttctctgcaggatttcaggttcttgaggagcaatactataactcatggcttcataggtatggactattatgtcaatatacatgctaattggaccttattatgacaatttgccctgagttacatttactgccacttgaattttaagtgttcattgtaaatatctaaagacgatgcttgcaagttaatatgttctatctttggtatgtgccactttatgtgaaagaaatttgcacttattgtttgtagtggccagagagttgtcgtacatgatgcacatgaaaacaagtcaggcagtgtcgtcaccatccaggttagcacaaaacagaactgttatggttgaattgatatttctgcttacctaattatggtgttaatcgtttccaggggttaacaccaactgggtacttacatgctattggtgaggataacaaaagctatgagttgcacccagatggcaacaggtattgtccattgctccgttttttcatccattaactttttttgttctatatataattactcagtatgtatacaatgttttttatgtgtctcatcttatatatgtcctcaacatgtaatcgattgttctatcactaactattctttgtcaggagtgacatttgacatagtaccatctgtttgcagctttgatttcttcactggattggtgaggaggaagatggaagcttagggtatcaatacaatgggatacatggatagattcaacagactgtacaaatgaatggaatgagaacatgatttaagcatcagccccctccatctgtattcaaaccttgtgcttggaataaatagaaggaatgctcttatcacaatcctgaacggccgctttgagacctcaaaccttaacaagtgccccaccctcgcaattccatttgcgacagctcagcataaacaattaagaagacaatcaaccgtgactgaagcccaggcatgagttcagatctcaggtgaagaaatcgcagtgactgaagaccgtttacttgaatgattcatatttcataggaagaatgcatgaaaattatgaagcacatctgctccattgatgggcggacagcttcttcggcagtgtttggggctcatgtttgcatcaggttctgtataactgcagtgttttttctattagtgaactaagttggaaatctgctgcaactgcaagatttgtagcggtgatgtatgagttggtaacttgtatttgcacagatgcttaactgaaaggacatgttatatattatcca

SEQ ID NO: 306 - DNA, 2831 bp, Zea Mays; identical to SEQ ID NO: 131

SEQ ID NO: 307 - DNA, 1653 bp, Zea Mays
tcgggccagagaggaattaattgttaaacaccttctcgttatccatcgctgtgccgggtgcctccgtcagcacgggacgactcggtttcggatgcagtgcatgcatgcaaactacgcgcgcgcagctttgattatttcgcgcgtcgaagcacagcaggccgagcaggccgtgtccaagatgattaacacacgtaacgtacgcacgcagtcaaactagctaacacgcgcgctgtgcagcaccatgctgcaccaaccggctatatatacgtatgtccatgtacaccaagcctcaagaagctcgcatcgcaagccgatcttttactcctccttctctaattcaagccaagacatagcttgtaggctaaagcaatggcaagcgtcgtcgtcaggcccagcaagctcctccttgctctccttgtcgcggcaatggcagcgtctcctcgggctctcgcgtacgacccgagccctctgcaggacttctgcgtcgccgacaccgcctccaacggtacgtgttgcacggtgcacgtacgtgcgggccgtgcggcctagctagctatagcttagctcttgttgtatactcctcgtccatataccatccttctgagttctgacgtacggtacctctgcgcgcatacctcgcgcatgcatgcaatgcaatgcaatgcgtcgcagtgttcgtgaacgggcaggcgtgcaaggacccggcgcaggtgacggcggccgacttcgccttctcgggcctgcaggacgcgggcgacaccgggaacgcgttcggctccaaggtgacgctggtggacgcgcgggcgctgcctgggctcaactcgctgggcgtcgccatggcgcgcctcgacatcgcgccgggcggcgtcaacccgccgcacacgcacccgcgcgccaccgaggtgctcaccgtcgtggagggccagatgtacgccggcttcctcgccaccgacggcaagctcttcgccagggtgctcaaccggggcgacgccttcgtcttccccaggggcctcgtccacttcgagttcaactgcggcgccggccccgccgtcggcctcgccggcctcagcagccagaaccccggcctcgtccgcgtcgccgactcgctcttcggcgccgcccccgccgtcaccgacgaggtcctcgccaaggcgttcaggatcgacgccgccaccgtgcagaggatcaaggcgcagtttgccaaaaagtagattgttgttcactgctagtaaaatggcccgtcggtgtcctttattgttgtttgtgtatagattccctggctgaatattgcccgggtatcggtcctttatttgtcatcaaattctgatttggttactttttttttcttgtctgtattaattcatcatgtccttattggataaatatttctgttttttaagtagtcgaacaatgcaattataatctatcttgcacatcttattaaaacaattaatctatattccctttatccatttctttaacggcatcagcgctgctgttttgattatgtgtttagccgatcaaggtttgtttagttcattactatttactacggccctgtatagaacggcaacaaatggctccgactccctggcacagacgcacagtcgtagacgaagtggaacaaataataaaacaaaaagaatactccca

SEQ ID NO: 308 - DNA, 330 bp, Zea Mays; identical to SEQ ID NO: 133

SEQ ID NO: 309 - DNA, 3073 bp, Zea Mays
atgagggagatcctgcacatccagggcgggcagtgcgggaaccagatcggtgccaagttctgggaggtgatctgcgacgagcacggcatcgaccacacgggcaagtacgccggcgactccgacctccagctcgagcgcatcaacgtctactacaatgaggccggcgggggccggttcgtcccgcgcgccgtgctcatggacctcgagcccggcaccatggactccgtgcgctccggcccctacggccagatcttccgccccgacaacttcgtcttcggccagtccggcgccggcaacaactgggccaagggccactacaccgagggcgccgagctcatcgactccgtgcttgacgtcgtccgcaaggaggccgagaactgcgactgcctccaaggtaccgtcgtcatcgtcgtagatctgtcccttctgttagaaatgctggtaatttcgtcgggatttgggggttgtcagcgtgcggatctagcgcatttctatagttagaatggcatgttgccatgttgtggttcgcggctcgtagatctagccatttgttggcttgcatggaaatctatgtagatctgggcgttttcctccacattttcgtttttcgagtatgcattctatttagagtataataactggctgtgagctggctaaacatggaagagagacagacaggagacagagtagaagagggctataaggctattcgcagtctaatatatcttggcacaatatctaaacttgccatgtcatataaaattacatatgatacaactacctcaatgcatgatattgtagactgcctctttatcctctataaaattttaaatgctagtatacgtgagagtagatatcgtggaccattttgatagttaaagtttcaatgcatgtggtctcgtgttcaagtagtatctcctccaagatataactttattctctttcatcttaactattttgccacatcatcaaaaatgcttacctgacatgtattaaatatttatgatactatgaattgggaatagcctaaactaacagccagcttatacacataaattaaccaataattcttgtgagagagacaagtggactatatattaattgtgaagggctaactattatatatatcggctaaggtaggctggccaacagttggctatattattaaccttgctcttatgcggttcaaactacgcagatcaagcttgttcaattgcagcatgcatagcatttaatttggcatttctgccggcatggttagactttagtggcgtgatccttcgccacaaatttggccaggtgcctgctttggtctttggctctttcgtactactagtaactgcgaaggattcattgagacatttaacttgagaaacgagcttatataactgatgatttatgtatttaactctatagatgttaagctattttctttgctttggctgttctagagttctctgttatttgtgttttgttgtttatgaaaatcgtgcaaatggctgagcccctgtgcacgtgagataaattcatctgtcaggctagtaaagtacttagctacaactcatattggctagcggttacggtaggatatttgcttgtgattcatgttgggtgttccattttgctaggtttgtccttcttggtgtagaaaaattacttttgtctctttcatttatgcttcagcttgccaaattgcatctgaaataatctttaccttttcttctgcaggatttcaggtttgccattcattgggtggaggtactggctcagggatgggcaccctgctcatctccaaaatcagggaagagtacccagataggatgatgctgacgttctcagtttttccatcacccaaggtgtctgatactgtggtagaaccttacaatgccacgctctcagttcatcaacttgttgagaatgctgatgagtgtatggtcctcgacaacgaagctctctacgacatctgcttccgcactctgaagcttgctacacccacttgtaagtttgcattgctacttttgctcagttactgcaaccacagcttcagtatcaatccataatttatttcatactgtatagtattgtggtagtcatcttcgtttgaagtgctgtgacacaaaactttctttgatgtcttgtgatgctgcattgaattacattatatggtccttgtctgtcatagatgcatatttattgcaatcatgtgctacttgattgaattaatttgtatgtcaggcacatgcatctcacaagcattttgtcaccatactatctgttctaaggtttgctttgtgctcctactgtcctgagatgaccatttcatgattccctgccttatttcttgcatttgtttctgccattaagatatgaatctgaatgttgccatttttatgctgttccagtcggtgacctgaaccatctcatctctgcaaccatgagtggtgttacctgctgcctgcggttcccaggccagctgaactcggacctccggaagcttgcggtcaacctgatccccttcccccgcctccatttcttcatggtcggcttcgcgccgctgacgtcaagggggtcccagcagtaccgcgccctgaccgtcccggagctgacccagcagatgtgggacgcgaagaacatgatgtgcgcggctgacccgcggcacgggcgctacctgacggcgtcggccatgttccgcgggaagatgagcaccaaggaggtggacgagcagatgctgaacgtgcagaacaagaactcgtcctacttcgtggagtggatcccgaacaacgtgaagtcgagcgtgtgcgacatcccccccacgggcctggcgatggcgtccacgttcgtcggcaactccacctcgatccaggagatgttccggcgcgtcagcgagcagttcacggccatgttccggcgcaaggccttcctgcactggtacaccggggagggcatggacgagatggagttcaccgaggccgagagcaacatgaacgacctggtggccgagtaccagcagtaccaggacgcgacggcggaagaggaggaggagtacaaggagggagatgaggtggctgcctga

SEQ ID NO: 310 - DNA, 4632 bp, Zea Mays
atggagttcacgcttatcccaaatttagtaccacaaaatagacatgctgttataaaagtatatgtctcgagaaaatggatttttcgtggcgcaatggacaatggacctatacatcacatcgatcttgtgttgatagacaaataggtaaaaaatagacctattatattaaacattttaaatagacaattgattagtagttcttacatttataacattttttatctctattgtacagggtaatggtataagtgctgaaatcccaggaaatctagctgaagagaaaggatctatcatcgaagaaaatgaaatatatgagatcagtagattcacaatatcttcagcaagacaaatgttcaaacctgttcatatagacaaaatgatccacttcacatatcacacaattattaaggcatcacttgattctccgtcaacatttcctagatatgtctatcatctgactccattgcatcaaatcgaatcctatattcaaaagaatgaatacttccttggtaagttcatcacatcaaaattatttacaaattattaatgtcggatgttatattgacctgttttatgtctttttccaatatcaacacttctgttactattatatgatgtattagatgtgctcggagttatcactcaagtgagtgcattaaaaccagttcggacacagacccgggaaagctcaaatgtcataaaagagatcatcataaaagatatcaagtatgaaacatttacttttatgtaacacatttttagataaaatttgcatttttttaaattcaccatataattataatgtgcagtgatgtcacaatgagactaaccctatgggcagaacgagctaaagcttttaaattagatgatgtttacaatcctctagagcaaaagccaatcgtcacactctttgtaggttgtttagccaaaaatttccaaggtacatacaaataatatcaacattttgttttcacattttcctgttaacatagcaagacaaattcaatcaaattttaaagaactaatttaattttttttaccatgaaaaaacaataggtgcatacttaaatggtggaacaacatgtagatggtatttcaatcctgatattaaggaagccgctccttattatcaaaggtatgtcctttctacaaataaataattcactacattatttcgcttttatacacccttttaagccaacatatactcactcagatattatcaatacttgcaaacatatttctgtacaggtttggatctcaaaaagtaaaactacaaataccatcagagcaggaacaacaactatctgttgcaaaagaaacacatgtagaacacaaaaccttgcatgagcttcttgcgttggatccatatgcatttccggtatgaccataaaaacatatttttaccaaccattacaattaacaattaaatatattctgctatatttatgtactgacgattttatagaaacaaggatatgaatgcacagttacaatcatagaagtacctacaacaaatcgttggtggtttccagcttgcaccaaatgcagtcgagcatgtagaccacaagatggtggttactattgctcctactgtaaatcagaagcgtacacactaaggtaaacttccctcattattctaataccctctactaacacactacctaaaattactcttttctctctcttactcttcttcttcattccttgtagaaccattagcaggttctaaattcaattatattgctactcatggtaacaaataagacctaatgtgttttaattatataataacattgcagatataaattaacattcatgggatcagatgcaacagcaacagcgcaaatgttttgctttgatactgtagcacgacatatagttggcagaccatgtgaaacggttctgaaacaagccactgaagcaacaccaatacctccagatctagcacaaatagtatccttaaagtttacatttcgtgttacagcatcaaaccaaacattcgctcaacgagagaagcaacccactgtgttacaaataaattctatagttgtacatggaagacaacactatctaccatcaggaattcaaaacaccatagatcaaggtccatcaacaccaaacaaagaagctacactcaaattattagaagaatcaccttctattgctatggaaaggttatcaacaaaagtatccaaagatgtaagctatttctccatatttcttatattggtatatataacaaattcaataaatttgacacatatttgtatttatcttacattttaggttggcagaaaactcacatattcaacacaggacaaagacatcatagggtacttgttactatctttaaatttaaatacacaaacttttaaaaggcatactaagtttcttagtgtatccacacaacaacaaaaattaacgtattccatctgcaggtctcaagtcttggatgtagcacaaggaactaatgcagataaggtaacttcgttatcaaccaaagcaaacttaaacaaacaaaatattacgctaattctattttaataattgcagggaatccccactgataaaggcaaagagatcgaacctcatcttcaatctcctccaaaaaggtaaacctctaaacaaatacctcatagacatcaacgataccaactgtttttatgtgttgtagcacaaaacaaatatttatgtgttaatacgtaataatcagacaatttattaaaactctaattttttcattcaacaggcacaaacaaggaccgctgacaatcaaagagtagacaagaccaaggcaccaccaagaatgatatgtgcaaccacatggaactaattcaaaaatggctactgtctttattctgtgcaagctagccacccttttgcaactttataaatgtagtactgacatgccacaaacagttcatatggctagctcattttccttttgaatgactgccttttttacaaaaggcataaatattgtataattaatattcggatcacactaaatgcttaatgctttaaacattatatatatatgccatcaaggtctgtcttcctctctgtatcatattttccgtatcatacatattatggcgcgctggacgcgcattagtcactagtttctatatgattcctgtgacattcgtacgttctaaggaggcctcagggaggtcttgcgtgaaccttgcagcgctccttccgccgttccgatacttcttctccctccacttgtcattacgcagacggatgatcaagatcaaatcctcaaacttctcgtgcatctcctcgaatctttaagatcttgttcgtttgtgtcgaattggtgggtcggaaagattcctagccggattgctactctaatttatataaactttgattagctgtaacgattccgggtgcaatccgacacaaacgaacatggcctaaaaggcatactaagtttcttagtgtatccacacaacaacaaaaattaacgtattccatctgcaggtctcaagtcttggatgtagcacaaggaactaatgcagataaggtaacttcgttatcaaccaaagcaaacttaaacaaacaaaatattacgctaattctattttaataattgcagggaatccccactgataaaggcaaagagatcgaacctcatcttcaatctcctccaaaaaggtaaacctctaaacaaatacctcatagacatcaacgataccaactgtttttatgtgttgtagcacaaaacaaatatttatgtgttaatacgtaataatcagacaatttattaaaactctaattttttcattcaacaggcacaaacaaggaccgctgacaatcaaagagtagacaagaccaaggcaccaccaagaatgatatgtgcaaccacatggaactaattcaaaaatggctactgtctttattctgtgcaagctagccacccttttgcaactttataaatgtagtactgacatgccacaaacagttcatatggctagctcattttccttttgaatgactgccttttttacaaaaggcataaatattgtataattaatattcggatcacactaaatgcttaatgctttaaacattatatatatatatgccatcaaggtctgtcttcctctctgtatcatattttccgtatcatacatattatggcgcgctggacgcgcattagtcactagtttctatatgattcctgtgacattcgtgcgttctaaggaggcctcagggaggtcttgcgtgaaccttgcagcgctccttccgccgttccgatacttcttctccctccacttgtcattacgcagacggatgatcaagatcaaatcctcaaacttctcgtgcatctcctcgaatctttaagatcttgttcgtttgtgtcgaattggtgggtcggaaagattcctagccggattgctactctaatttatataaactttgattagctgtaacgattccgggtgcaatccgacacaaacgaacatggcctaaaggtggctctcggctctctccagccccgactccaagaagttggcggtcgcatccggcgtatcgaggtcggtgctcttcctgctcgtcgacgtcgctgtcaaagctgttgagtccgagatcacttgttttctgtattccaaatga

SEQ ID NO: 311 - DNA, 672 bp, Zea Mays; identical to SEQ ID NO: 136

SEQ ID NO: 312 - DNA, 1363 bp, Zea Mays
cgtgtcacggtcgccgccacagccccagttccaggcgcggccgtacgggcccggaccacggacgcagcacggcaccggtgggacccgccccccgtcgtccgtcccatccggtcggtccctgtggctgggcccacgcaccgccggaagctggctgctgggtggtggtggtggcgctggcaaggccggcacccggcagcagcagcagtccactcctgtccacccccaccggtgggtggctccttaaaagggccggcggccatggtcaggccggcaactcgggcccggctcactgggtttctgtcccccgcatctgtagccgggcgggtacaaaacttgtactacgacgcgacgcctcccctccggcctccaggctcccggctccggctgcctctttctcttctctcctgctcctttctataaagcgcggacctcccagtcccactcccttcccgcaccgcagacgcagagcagccaaacgccacctcgagcccccgagcgcctgcgcagaccgcagccaggaaaccgccttctccgacatccggctctcctccacgctcccgctactccgctccagctccaccgccaccaccaccaccgacccacccatcccatccagccatgaagcggctcctgcggcggctgtcccgcacggtggtggcggcggcggcgtccagcgaggacggcggtgcggcggcgcggcccagcagcaaggacgacgggagcaggaggcgcaggaggaagaaggcggggtccgtgccggagggccacgtgcccgtgtgcgtgggcgaggagggcggccccgtggagcgcttcgccgtgcgcgccgagctgctgggcgagccgcccttcgccgcgctcctccgccgcgccgcgcaggagtacggctacgcgcaccccggcgcgctccgcatcccctgccccgtcgccgacttccgccgcctcctgctccgcctctcccgcgaccccgcgcccgccgccggacgctacgcctacgcctaggcgccgtccgtccctacttcgtgctctccgccgccgctggagaccgtctgcgcttccgcggttttagccctactactagggggcggcaggatggggctctcctttttatttttcctctttttttacggcttgctagtgtagtagccgtactagcagtagctgctcgatggaagaactacagccgggtgtcttatttttttacccccttctggttctaggactctcctcgcagtgtggtgcgcgtctgtgcttagaaaaaagttggctggagaattcggcattaaccgatgctcctccatttccatccaggccattcatattagtgttgcctgttgatgaggtaatcagtaatttcctctttttt

SEQ ID NO: 313 - DNA, 2155 bp, Zea Mays
accaacaagtgcagtcacccgagccgcaaactgcagctctgcaagctacagaggccaccacgagtccacgacgccacgccctccgagagaaagagaaagagaaaaccaaagcacgataatgcccccgacccccacagccgccgcagccggcgccgccgtggcggcggcatcagcagcggagcaggcggcgttccgcctcgtgggccaccgcaacttcgtccgcttcaacccgcgctccgaccgcttccacacgctcgcgttccaccacgtggagctctggtgcgccgacgcggcctccgccgcgggccgcttctccttcggcctgggcgcgccgctcgccgcacgctccgacctctccacgggcaactccgcgcacgcgtccctgctgctccgctccggctccctctccttcctcttcacggcgccctacgcgcacggcgccgacgctgccaccgccgcgctgccctccttctccgccgccgccgcgcggcgcttcgcagccgaccacggcctcgcggtgcgcgccgtcgcgctccgcgtcgccgacgccgaggacgccttccgcgccagcgtcgcggccggggcgcgcccggcgttcggccccgtcgacctcggccgcggcttccgcctcgccgaggtcgagctctacggcgacgtcgtgctccggtacgtgagctacccggacggcgccgcgggcgagcccttcctgccggggttcgagggcgtggccagccccggggcggccgactacgggctgagcaggttcgaccacatcgtcggcaacgtgccggagctggcgcccgccgccgcctacttcgccggcttcacggggttccacgagttcgccgagttcacgacggaggacgtgggcaccgcggagagcggcctcaactccatggtgctcgccaacaactcggagaacgtgctgctcccgctcaacgagccggtgcacggcaccaagcgccgcagccagatacaaacgttcctggaccaccacggcggccccggcgtgcagcacatggcgctggccagcgacgacgtgctcaggacgctgagggagatgcaggcgcgctcggccatgggcggcttcgagttcatggcgcctcccacatccgactactatgacggcgtgaggcggcgcgccggggacgtgctcacggaagcacagattaaggagtgccaggagctaggggtgctggtggacagggatgaccagggcgtgctgctccaaatcttcaccaagccagtgggggacaggtaaaatcgttatctttttcaccttttttgttttacaagtgtgcatgatgcatctagaattgcaaaggaacaattccaggataaggtattcagctagttcaggattgcaggcatatatagaatatatatacagtacgaaggtatcaaaccctctttttgtgcctccatgcatgatgcatctttatgaagaccgtgacagcaaaaaagaggatcctttttgcatgctgtgaatcataattcgagctcccatgtcccagctgattacatgatggtcaacattccattctcatcattaatcccctgcactttaattctgaagatcatagctcagcattctagtgtcaatgccatggtttccttgacccctatgcaatccaaaatctaactggaccagctgcgtcattcaggccaacgctgttcttggaaatcatccaaaggatcgggtgcatggagaaggatgagaaggggcaagaataccaaaagggtggctgcggcgggttcggcaagggaaacttctcgcagctgttcaagtccatcgaggattatgagaagtcccttgaagccaagcaagctgctgcagcagctgcagctcagggatcctaggacagtgcttggagacgagcaactgctgtggcactttgtatcatggaacagaaataatgaagcgtgttctttgtgacacttgacatgcaaatgtttgtgttctgtaaccgttgaatatatgggacgatgctatgatggtgtaatagatggtagagagggtacaaccctgatactaatgatgcactattgcatctctgttgtacaagtttgcatgaaaataacgacgagggtcagtatgaggcataatgaatctgttcctgggattcttgtactcacctggtgctttttttttatg

SEQ ID NO: 314 - DNA, 5118 bp, Zea Mays
tgatccgctggcgctcgcggtgaggcgtcgaaggtcaacccctatcttccacctcggggggactgcctacccggtggatcgacgcagcagctttattggttccccggagacctgcaagttgcaagacgagctagacctagcaaccgctccctgccgaccttcggcgtcttggagtaaacatttcggcgtccaggcaagtaagcaactcatgtactcaccaattatttcgcagatggttccaaaggttctcacgaccctagggtgttcgatggaatgcgtagctgacaattatttcgccctttttcagtaccgaagatctcccatccgctctgtcgatttgcaatggagcccggcagcccagccccgaagaaatcacggctggtgcactcagcggactgcgaaatggaggaggcgcaggcgccttccagttccaatgcagcggggggcgtgaaccagagcttgcactggacccagtggcagatcctggactccatcctcccgaccggcggcttcgcgcactcgtacggcctcgaggccgccatgcagtcccgcgtggtgaacgaccaggaggacctgaggtcgttcgtcgtccaggtcctcgacagcgccggcagcctgctgctgccgttcgtgcactgcgcatgcgcaggcaagtcccccggcgacgcagcggcgtgggccaagctggaccggttgctggacgccacgttgacgaacgaggtcgccaggaaggcgtccgcggctcagggctcggctctgctgcgggtggccgcgtccgtcttcgccgaggttccggcgctgcaggagctccggcggacgttgctgggctccaagagcgtgtcgttccaccacgcgcctgtgtttgggctggtgtgcggcttggttggattcgacggcgagacggcgcagcgggcgtacatgttcgtgacgatgagggacgtgctctctgccgcgacgaggctcaatctgatcggcccgctggctgcttcggtgctgcagcaccagcttgcgccggatgccgagaggatggtgcggaaatggagggaccgtgatgtctctgaggcgtcacagactgccccgctgctcgatgccgtgcagggctgccacgcttacatgttctccaggctgttttgttcgtgacaacaaggtgagctacctaccttcgtatgatctttgagcatatgcagcacattcaaagatgctccggtcatgcttccatgcttttctgataaatttctgttaccttttgagtaactctgcatgagacctcttcaatgatacgtagtgtttgatggctcgcaaggcaattgtgtgacaagctttggatgagtgatgtgctctatcaaggacgtgatgagtattccctttcaaaaaaaagggcgtgatgagtaattatttaattctgtagttacaaccaaatttaagtagaactacaaacatgcattcagagagggctggaaaattagctcgaggctcgcgagcctcgaacgagccgagccccttcttcgagctcgtttttgcagcgagccgagccggctcgttccagctcgcgagccggctcgcgagccttgcgaaaatgatcaatttatggaataataataataattagataattttatggataatagctcattttttagtctttgatgatgaatatattacaagttatagtttaatttactcataatgtagaatgatgattctatatttcaaatttatataatgttaatttaccaaataatgcaacaataagtactaaaatatggctcgcgagccaaggtcgagccgagccgagcctcttccgccagctcgtggaatggacgagccgagctcgttcaggcatcgagccgcgccgagccgagccgagccgagctcggctcgtttccagcccagactgttagactgtgtgtgtgtgtgagtgtgtgtgggccggcaccactgttgggctgccggcccattagggttagggttaggtttgagtccctataaatatgtgtacccatctcctatcaatatatccactttacacttctacatggtatcagcctaggtttaggttttcctctcccacagcagggcagccgccggctgctcccaccctacagccgtcgcctaccatcgttgcccccgggaggctcaaccttccctcccgggggcggcctccctcctcccaaccgtccgcacccccactccttccccagccgacctctggccgccgccacccccgagccggcgagctcgggctccctccggccgcctccatcccttccccgaccggcgccttcctcctccccttgccggcgagcgcgggcccaagcgcgccccgaccagccggctcgcttctctcccttctccggcggccggctgctactgctcgacgccggatgggggagacgacgcgacgctcgctcgtggactggcgcccatgggacgaagctgcggactccctcgatcggccaccgtcgtgccctctctgggcgcgccccccactgcggcgccggtccagctgccagggacgcccgcgccaaaccccctccccggcgcgcctcccgctgcgccgctgcccctgctgccagggacgcccgcgccgaaccccttcctggcacgcctcccgctgcgccgtcgcccctgctgctcactcggctcggatccgcgcccctccccgacggtgtggtcgcagcgtcccagcagcacgggcgcaggctggccggccatccccggtgcgcaggccccagcgtgcggcccggtcggtggtcccggtgcacggcttcgacccccacccgccgccggcgcccctgctagggccagtccttgccgtcggccttaggacggatggagctctctgccccatggccgtcggcctccctggcatgtagcgccgtctcccatgacgctctgcccagcagcgcctcacccttcaagcttctcccgacgccggcaccgttatcatcccttgccaggtccggcgcaggcccttgctcggctggacccgccccgtcgccctcccccttcatcgccgccatcattggttccgtcgctgccacggcctccccggccggatccacgttgctgcggccttctcggctagatccgccatccctttggccggatcgccgtcttcatggctggattcgtcgctgccgtgaccttcccggccggatccaccgataccccttctactctgcagcgggcgcggacaccctgaccggcgcagacgcgtgcgctgccgtcggcctccctggcgagtctccttgacgcctggtcgatcgaagaagcaggaaggtcggcctgttggtgcccttttgctgtgtcgccctgccgatcgttgacgctcgaacgtcgacccctcccgaagattaggcttttgctgcgcgtcttccgaccgcgaccacctcgacttcggctacctcggcatctaggggctatcgtcttcttggagcacacaacggtctctgctccagccgcaacattcgcaccatcacgacgctgcgactgcggggggatttcaacccgtcggctcctaccttcggcctctactccagtctcatcgtgtgtggtgcccccgttgcgactgcggggggatgttagactgtgtgtgtgtgagtgtgtgtgggccggcaccactgttgggctgccggcccattagggttagggttaggtttgagtccctataaatatgtgtacccatctcctatcaatatatccacttttcacttctacacagaccactatatgcattgatgatcttcccatccaagtgaagtgttggattttgagttgtgcttaagttgtctgatattgatgcatatgataatctacagcattctatacaaacactgcatgtctgcatcagatatatggaacagatctacagcataatatattgatgaatagcatttctttaattttacagccatacacgatacatatccctggacaaaactagcagccttccatggccatggctgatggctccaagtgatttctgtacgtttaagtagttacctgatattgatgcatatataataatctacagcccagtgctagactgctagtagacaagaggcttgccaggtccattttgtgctgttctagctaggtcacagaactcaatatcaacacgtgaatgcctgatacaccaaacaagatgtctagatgcgcttatcttactctgcatttctattttacctctgcttctttcaggttactgagatcaatgcgcaatctgttgtattcttgccgcaggatcacatcgacaggagccaacgacagctgtcttctcataaaaaaaaagcaccaggtgagtacaagaatcccaggaacagattcattatgcctcatactgaccctcgtcgttattttcatgcaaacttgtacaacagagatgcaatagtgcatcattagtatcagggttgtaccctctctaccatctattacaccatcatagcatcgtcccatatattcaacggttacagaacacaaacatttgcatgtcaagtgtcacaaagaacacgcttcattatttctgttccatgatacaaagtgccacagcagttgctcgtctccaagcactgtcctaggatccctgagctgcagctgctgcagcagcttgcttggcttcaagggacttctcataatcctcgatggacttgaacagctgcgagaagtttcccttgccgaacccgccgcagccacccttttggtattcttgccccttctcatccttctccatgcacccgatcctttggatgatttccaagaacagcgttggcctgaatgacgcagctggtccagttagattttggattgcataggggtcaaggaaaccatggcattgacactagaatgctgagctatgatcttcagaattaaagtgcaggggattaatgatgagaatggaatgttgaccatcatgtaatcagctgggacatgggagctcgaattatgattcacagcatgcaaaaaggatcctcttttttgctgtcacggtcttcataaagatgcatcatgcatggaggcacaaaaagagggtttgataccttcgtactgtatatatattctatatatgcctgcaatcctgaactagctgaataccttatcctggaattgttcctttgc

SEQ ID NO: 315 - DNA, 5124 bp, Zea Mays
gcagcgtgatccgctggcgctcgcggtgaggcgtcgaaggtcaacccctatcttccacctcggggggactgcctacccggtggatcgacgcagcagctttattggttccccggagacctgcaagttgcaagacgagctagacctagcaaccgctccctgccgaccttcggcgtcttggagtaaacatttcggcgtccaggcaagtaagcaactcatgtactcaccaattatttcgcagatggttccaaaggttctcacgaccctagggtgttcgatggaatgcgtagctgacaattatttcgccctttttcagtaccgaagatctcccatccgctctgtcgatttgcaatggagcccggcagcccagccccgaagaaatcacggctggtgcactcagcggactgcgaaatggaggaggcgcaggcgccttccagttccaatgcagcggggggcgtgaaccagagcttgcactggacccagtggcagatcctggactccatcctcccgaccggcggcttcgcgcactcgtacggcctcgaggccgccatgcagtcccgcgtggtgaacgaccaggaggacctgaggtcgttcgtcgtccaggtcctcgacagcgccggcagcctgctgctgccgttcgtgcactgcgcatgcgcaggcaagtcccccggcgacgcagcggcgtgggccaagctggaccggttgctggacgccacgttgacgaacgaggtcgccaggaaggcgtccgcggctcagggctcggctctgctgcgggtggccgcgtccgtcttcgccgaggttccggcgctgcaggagctccggcggacgttgctgggctccaagagcgtgtcgttccaccacgcgcctgtgtttgggctggtgtgcggcttggttggattcgacggcgagacggcgcagcgggcgtacatgttcgtgacgatgagggacgtgctctctgccgcgacgaggctcaatctgatcggcccgctggctgcttcggtgctgcagcaccagcttgcgccggatgccgagaggatggtgcggaaatggagggaccgtgatgtctctgaggcgtcacagactgccccgctgctcgatgccgtgcagggctgccacgcttacatgttctccaggctgttttgttcgtgacaacaaggtgagctacctaccttcgtatgatctttgagcatatgcagcacattcaaagatgctccggtcatgcttccatgcttttctgataaatttctgttaccttttgagtaactctgcatgagacctcttcaatgatacgtagtgtttgatggctcgcaaggcaattgtgtgacaagctttggatgagtgatgtgctctatcaaggacgtgatgagtattccctttcaaaaaaaagggcgtgatgagtaattatttaattctgtagttacaaccaaatttaagtagaactacaaacatgcattcagagagggctggaaaattagctcgaggctcgcgagcctcgaacgagccgagccccttcttcgagctcgtttttgcagcgagccgagccggctcgttccagctcgcgagccggctcgcgagccttgcgaaaatgatcaatttatggaataataataataattagataattttatggataatagctcattttttagtctttgatgatgaatatattacaagttatagtttaatttactcataatgtagaatgatgattctatatttcaaatttatataatgttaatttaccaaataatgcaacaataagtactaaaatatggctcgcgagccaaggtcgagccgagccgagcctcttccgccagctcgtggaatggacgagccgagctcgttcaggcatcgagccgcgccgagccgagccgagccgagctcggctcgtttccagcccagactgttagactgtgtgtgtgtgtgagtgtgtgtgggccggcaccactgttgggctgccggcccattagggttagggttaggtttgagtccctataaatatgtgtacccatctcctatcaatatatccactttacacttctacatggtatcagcctaggtttaggttttcctctcccacagcagggcagccgccggctgctcccaccctacagccgtcgcctaccatcgttgcccccgggaggctcaaccttccctcccgggggcggcctccctcctcccaaccgtccgcacccccactccttccccagccgacctctggccgccgccacccccgagccggcgagctcgggctccctccggccgcctccatcccttccccgaccggcgccttcctcctccccttgccggcgagcgcgggcccaagcgcgccccgaccagccggctcgcttctctcccttctccggcggccggctgctactgctcgacgccggatgggggagacgacgcgacgctcgctcgtggactggcgcccatgggacgaagctgcggactccctcgatcggccaccgtcgtgccctctctgggcgcgccccccactgcggcgccggtccagctgccagggacgcccgcgccaaaccccctccccggcgcgcctcccgctgcgccgctgcccctgctgccagggacgcccgcgccgaaccccttcctggcacgcctcccgctgcgccgtcgcccctgctgctcactcggctcggatccgcgcccctccccgacggtgtggtcgcagcgtcccagcagcacgggcgcaggctggccggccatccccggtgcgcaggccccagcgtgcggcccggtcggtggtcccggtgcacggcttcgacccccacccgccgccggcgcccctgctagggccagtccttgccgtcggccttaggacggatggagctctctgccccatggccgtcggcctccctggcatgtagcgccgtctcccatgacgctctgcccagcagcgcctcacccttcaagcttctcccgacgccggcaccgttatcatcccttgccaggtccggcgcaggcccttgctcggctggacccgccccgtcgccctcccccttcatcgccgccatcattggttccgtcgctgccacggcctccccggccggatccacgttgctgcggccttctcggctagatccgccatccctttggccggatcgccgtcttcatggctggattcgtcgctgccgtgaccttcccggccggatccaccgataccccttctactctgcagcgggcgcggacaccctgaccggcgcagacgcgtgcgctgccgtcggcctccctggcgagtctccttgacgcctggtcgatcgaagaagcaggaaggtcggcctgttggtgcccttttgctgtgtcgccctgccgatcgttgacgctcgaacgtcgacccctcccgaagattaggcttttgctgcgcgtcttccgaccgcgaccacctcgacttcggctacctcggcatctaggggctatcgtcttcttggagcacacaacggtctctgctccagccgcaacattcgcaccatcacgacgctgcgactgcggggggatttcaacccgtcggctcctaccttcggcctctactccagtctcatcgtgtgtggtgcccccgttgcgactgcggggggatgttagactgtgtgtgtgtgagtgtgtgtgggccggcaccactgttgggctgccggcccattagggttagggttaggtttgagtccctataaatatgtgtacccatctcctatcaatatatccacttttcacttctacacagaccactatatgcattgatgatcttcccatccaagtgaagtgttggattttgagttgtgcttaagttgtctgatattgatgcatatgataatctacagcattctatacaaacactgcatgtctgcatcagatatatggaacagatctacagcataatatattgatgaatagcatttctttaattttacagccatacacgatacatatccctggacaaaactagcagccttccatggccatggctgatggctccaagtgatttctgtacgtttaagtagttacctgatattgatgcatatataataatctacagcccagtgctagactgctagtagacaagaggcttgccaggtccattttgtgctgttctagctaggtcacagaactcaatatcaacacgtgaatgcctgatacaccaaacaagatgtctagatgcgcttatcttactctgcatttctattttacctctgcttctttcaggttactgagatcaatgcgcaatctgttgtattcttgccgcaggatcacatcgacaggagccaacgacagctgtcttctcataaaaaaaaagcaccaggtgagtacaagaatcccaggaacagattcattatgcctcatactgaccctcgtcgttattttcatgcaaacttgtacaacagagatgcaatagtgcatcattagtatcagggttgtaccctctctaccatctattacaccatcatagcatcgtcccatatattcaacggttacagaacacaaacatttgcatgtcaagtgtcacaaagaacacgcttcattatttctgttccatgatacaaagtgccacagcagttgctcgtctccaagcactgtcctaggatccctgagctgcagctgctgcagcagcttgcttggcttcaagggacttctcataatcctcgatggacttgaacagctgcgagaagtttcccttgccgaacccgccgcagccacccttttggtattcttgccccttctcatccttctccatgcacccgatcctttggatgatttccaagaacagcgttggcctgaatgacgcagctggtccagttagattttggattgcataggggtcaaggaaaccatggcattgacactagaatgctgagctatgatcttcagaattaaagtgcaggggattaatgatgagaatggaatgttgaccatcatgtaatcagctgggacatgggagctcgaattatgattcacagcatgcaaaaaggatcctcttttttgctgtcacggtcttcataaagatgcatcatgcatggaggcacaaaaagagggtttgataccttcgtactgtatatatattctatatatgcctgcaatcctgaactagctgaataccttatcctggaattgttcctttgc

SEQ ID NO: 316 - DNA, 5124 bp, Zea Mays; identical to SEQ ID NO: 315

SEQ ID NO: 317 - DNA, 4521 bp, Zea Mays
tgatccgctggcgctcgcggtgaggcgtcgaaggtcaacccctatcttccacctcggggggactgcctacccggtggatcgacgcagcagctttattggttccccggagacctgcaagttgcaagacgagctagacctagcaaccgctccctgccgaccttcggcgtcttggagtaaacatttcggcgtccaggcaagtaagcaactcatgtactcaccaattatttcgcagatggttccaaaggttctcacgaccctagggtgttcgatggaatgcgtagctgacaattatttcgccctttttcagtaccgaagatctcccatccgctctgtcgatttgcaatggagcccggcagcccagccccgaagaaatcacggctggtgcactcagcggactgcgaaatggaggaggcgcaggcgccttccagttccaatgcagcggggggcgtgaaccagagcttgcactggacccagtggcagatcctggactccatcctcccgaccggcggcttcgcgcactcgtacggcctcgaggccgccatgcagtcccgcgtggtgaacgaccaggaggacctgaggtcgttcgtcgtccaggtcctcgacagcgccggcagcctgctgctgccgttcgtgcactgcgcatgcgcaggcaagtcccccggcgacgcagcggcgtgggccaagctggaccggttgctggacgccacgttgacgaacgaggtcgccaggaaggcgtccgcggctcagggctcggctctgctgcgggtggccgcgtccgtcttcgccgaggttccggcgctgcaggagctccggcggacgttgctgggctccaagagcgtgtcgttccaccacgcgcctgtgtttgggctggtgtgcggcttggttggattcgacggcgagacggcgcagcgggcgtacatgttcgtgacgatgagggacgtgctctctgccgcgacgaggctcaatctgatcggcccgctggctgcttcggtgctgcagcaccagcttgcgccggatgccgagaggatggtgcggaaatggagggaccgtgatgtctctgaggcgtcacagactgccccgctgctcgatgccgtgcagggctgccacgcttacatgttctccaggctgttttgttcgtgacaacaaggtgagctacctaccttcgtatgatctttgagcatatgcagcacattcaaagatgctccggtcatgcttccatgcttttctgataaatttctgttaccttttgagtaactctgcatgagacctcttcaatgatacgtagtgtttgatggctcgcaaggcaattgtgtgacaagctttggatgagtgatgtgctctatcaaggacgtgatgagtattccctttcaaaaaaaagggcgtgatgagtaattatttaattctgtagttacaaccaaatttaagtagaactacaaacatgcattcagagagggctggaaaattagctcgaggctcgcgagcctcgaacgagccgagccccttcttcgagctcgtttttgcagcgagccgagccggctcgttccagctcgcgagccggctcgcgagccttgcgaaaatgatcaatttatggaataataataataattagataattttatggataatagctcattttttagtctttgatgatgaatatattacaagttatagtttaatttactcataatgtagaatgatgattctatatttcaaatttatataatgttaatttaccaaataatgcaacaataagtactaaaatatggctcgcgagccaaggtcgagccgagccgagcctcttccgccagctcgtggaatggacgagccgagctcgttcaggcatcgagccgcgccgagccgagccgagccgagctcggctcgtttccagcccagactgttagactgtgtgtgtgtgtgagtgtgtgtgggccggcaccactgttgggctgccggcccattagggttagggttaggtttgagtccctataaatatgtgtacccatctcctatcaatatatccactttacacttctacatggtatcagcctaggtttaggttttcctctcccacagcagggcagccgccggctgctcccaccctacagccgtcgcctaccatcgttgcccccgggaggctcaaccttccctcccgggggcggcctccctcctcccaaccgtccgcacccccactccttccccagccgacctctggccgccgccacccccgagccggcgagctcgggctccctccggccgcctccatcccttccccgaccggcgccttcctcctccccttgccggcgagcgcgggcccaagcgcgccccgaccagccggctcgcttctctcccttctccggcggccggctgctactgctcgacgccggatgggggagacgacgcgacgctcgctcgtggactggcgcccatgggacgaagctgcggactccctcgatcggccaccgtcgtgccctctctgggcgcgccccccactgcggcgccggtccagctgccagggacgcccgcgccaaaccccctccccggcgcgcctcccgctgcgccgctgcccctgctgccagggacgcccgcgccgaaccccttcctggcacgcctcccgctgcgccgtcgcccctgctgctcactcggctcggatccgcgcccctccccgacggtgtggtcgcagcgtcccagcagcacgggcgcaggctggccggccatccccggtgcgcaggccccagcgtgcggcccggtcggtggtcccggtgcacggcttcgacccccacccgccgccggcgcccctgctagggccagtccttgccgtcggccttaggacggatggagctctctgccccatggccgtcggcctccctggcatgtagcgccgtctcccatgacgctctgcccagcagcgcctcacccttcaagcttctcccgacgccggcaccgttatcatcccttgccaggtccggcgcaggcccttgctcggctggacccgccccgtcgccctcccccttcatcgccgccatcattggttccgtcgctgccacggcctccccggccggatccacgttgctgcggccttctcggctagatccgccatccctttggccggatcgccgtcttcatggctggattcgtcgctgccgtgaccttcccggccggatccaccgataccccttctactctgcagcgggcgcggacaccctgaccggcgcagacgcgtgcgctgccgtcggcctccctggcgagtctccttgacgcctggtcgatcgaagaagcaggaaggtcggcctgttggtgcccttttgctgtgtcgccctgccgatcgttgacgctcgaacgtcgacccctcccgaagattaggcttttgctgcgcgtcttccgaccgcgaccacctcgacttcggctacctcggcatctaggggctatcgtcttcttggagcacacaacggtctctgctccagccgcaacattcgcaccatcacgacgctgcgactgcggggggatttcaacccgtcggctcctaccttcggcctctactccagtctcatcgtgtgtggtgcccccgttgcgactgcggggggatgttagactgtgtgtgtgtgagtgtgtgtgggccggcaccactgttgggctgccggcccattagggttagggttaggtttgagtccctataaatatgtgtacccatctcctatcaatatatccacttttcacttctacacagaccactatatgcattgatgatcttcccatccaagtgaagtgttggattttgagttgtgcttaagttgtctgatattgatgcatatgataatctacagcattctatacaaacactgcatgtctgcatcagatatatggaacagatctacagcataatatattgatgaatagcatttctttaattttacagccatacacgatacatatccctggacaaaactagcagccttccatggccatggctgatggctccaagtgatttctgtacgtttaagtagttacctgatattgatgcatatataataatctacagcccagtgctagactgctagtagacaagaggcttgccaggtccattttgtgctgttctagctaggtcacagaactcaatatcaacacgtgaatgcctgatacaccaaacaagatgtctagatgcgcttatcttactctgcatttctattttacctctgcttctttcaggttactgagatcaatgcgcaatctgttgtattcttgccgcaggatcacatcgacaggagccaacgacagctgtcttctcataaaaaaaaagcaccaggtgagtacaagaatcccaggaacagattcattatgcctcatactgaccctcgtcgttattttcatgcaaacttgtacaacagagatgcaatagtgcatcattagtatcagggttgtaccctctctaccatctattacaccatcatagcatcgtcccatatattcaacggttacagaacacaaacatttgcatgtcaagtgtcacaaagaacacgcttcatt

SEQ ID NO: 318 - DNA, 962 bp, Zea Mays; identical to SEQ ID NO: 143

SEQ ID NO: 319 - DNA, 679 bp, Zea Mays; identical to SEQ ID NO: 144

SEQ ID NO: 320 - DNA, 974 bp, Zea Mays
atggctgacatggtctctggggttgctagccagggggctaggcctgctcttaggtggagtgccacaatgtctgggtttgttctacgccgatttgttgacttgataggtactggggttaggactgacaagggttttaaggaaatccaccttaactctgttgctaaaaatgtctccgagttctgtggccaagaagtaacaggccagcaagtgtacaatcaccttcgtaagtggaggtctaggtgggtcaaagtttgcaaactaaaggacattagtggcgctctttgggatgaggatacctttgtcataagcttagaagagggtcattatgctgcttacatcaaggttaggaccaacaccttccatttctctaatttggtctaacttgaaattgctaacttgagctgctaactcaataggatcacccaaaagatgctgattacctcaataggcccatagagaactatatggctatgcaaatcatttttggaagtggggttgccactggtaggtttgcaatgggttcaaatgagcctttgggcaagccaagtgacattgttgacatcttagatgatggcattgaagtgacctcagagtttgttgatgcttccaatctaactggcaagggaaagactgttgataagggtacccctagtgactccattgataccaagcctatgtccaacttagggaagagaaagaggtacatgactgatgaagatgttgtcgtgttcaatgggatgaaagaggttgtatctgatgttgctgctgctgtccgtgaaagcatccatgctgaagcagcacctgggatctacaatgctgtaatcaactgtcctgggttctctagggaggctctcatgtatgccctaaaccacatgatggagcacaaggccacctccctagtgttcctggacatgactcctgatgatcgtgacctatggctcaagacttttctagccaagcactaccacaactga

SEQ ID NO: 321 - DNA, 4352 bp, Zea Mays
atgttgccgccgccgccaccaccgtcctccttgcgcgaccttctctcgcgggagcgcgtcgacgaggacgaggcgccgcatctgtcgccgcgacgcgcctccgggcggtcacccccgcgccgcggggcgtcgtcgaggtcgtccaggcacacgtcgtcgccgccgctggccacgaccacgacaacgaccagggaggcggagggggaggccgccgccgccgacgcggtggtcgccgtgctgtccgcgtacgccgggaggctgctcagggacgcggaattcaggcgggcgctccgcgacaagtgcgccgcgtgcctcgcgcccgccgcgggcgcgggcgaggacgacgacgcggcggcaggccgccccgtgctggccaacctcgagctgggcatcgagagcatagagcgcctggccgcggacggctccgccgcgcagccacaggcgccgcgcgacgccaagatccggtcgctccgcaactccatccgcctcctcagcgtcgtcgcgtcgctccactcgccaccgccgccgccgcgccccggcgccgccgcgggggacggcggcggccgcacctgcggggtgcccaactcgcacctcgcagcctgcgcgcagctctacctcgccgtggtgtacaagatggagcgcaacgaccgcgtcgcggcgcgccacctcatgcaggtgttcgccgacgcgccgggcctcgcgcgcagggagctgctgccggacctctgggaccacgtgttcctgccccacctgctccacctcaaggtctggttcgccagggaggccgacgacctcgtcgctggccgggacgccgacgaccggcgcacgaggatgaaggccctgcagaggctctacagcgaccacatggacagcggcacggctcagttcgctgtgtactacaaggagtggctccagtcaggcgccgccgcgccgcctcccgtcccctcggtgccgttgccttcgacgcccaggagtttcgacgggcgcgagaagagctcggcttcggtgcacagaacctccatcaacagagacctgtgggtgaaccgtgaaccttcccatcccacagactgcattgcaagagcacaggagtttctcagagtttatctgaattctgcttccaggtataatgcggttttcgggacagctctcgctctcgggcaggaagacgtcaaggatacaaagctggacgatgggactggactagctctggatttggatgtcgaattggatcacgatgctgcgggcttcaagacacagaagcttgctcatgtgagtcgacagttccttcaactttctccagatgactactctactcctagatggtttgcctcgtagtaataatatgtgtttttttgtttggcaaggcaaactagcattggcatctatcttttagacaagtgacgagttgtggtcactgtttgcagctgacaatttaagtggtgccaaggagacagccgtttgatccacgtacagtataatatttgttttctatgccgtggggcctttttttttgtcatattcctaggatcctcagttgtctatggttggttgtagacatgtagcatccactgagctgttcggtttaaaaagcttgcctcctgaactgagaaacatctgtccttgacgcctcatagtattacacagttagccatcaaaaatccgatcttgatttaggagtaacatattaccctaaactggcaatgcaaagtccttctctttgctttagaataacactgctatatgtagtgttttaagctacatgttcctgtttgtttagtcccgcatatatatatatatttgaagttagttaacttgagcccgttttgagtagacagagtaaaatggggctccaggaaaagcactcccgctctcggaaagaaggcgccgctctagcagaaacagcacctgcgcagcggaaatcatactcctttcgactgttctcgtgccaaggcgatataagcaggaacgtgatcagccatcccaaagcagcgaagaaggaacccgtggtgtctgtcgagaaagagctggacagcagcgagctagctcctgctgtcgtgcctctgctggaacgagcggtttccgtggtatccagttcggacagcctgagtcagtgcgaggacgccgtgcacgaggtcgccagagcatgctcggcctgggacccgagcctcgtgaacctgctgtcgtgcgcctctttcatccaaggccttctcgaggtcacgctgacctccaaagacgacgccgtgctggagtcggccatgtcgatcatggggaagctggttctggggaacgaggtgatcagacagctcgtgctcaacgcggacccgcagctggaggttttcctgaggctcctgaggagcagcgagctgttcctcaaggcggccgtggtgctctacatgatgaagcctaaggccaagcagatgctgtccctggactgggtgccgctcgtgctgcacgtactggagtgcggcgacgaggtgcagtctctgttctccgtaagatgcgcccccaagatcgccgcgttctatttcctggaccagctgctcatggggttcgacgttgacagaaacgtcgagaacgcgaagcagatgatcgctctcggtgggctggacctcctgatcggcaggcttggcgctggcgacgctcgcgagagcaggcactgcatcgctctcctgaccacgtgcgttcaggccgatggcagctgcaggcactacttggctgatagtctcaagaaggagcctctcgttcagcttcttgctggaaatcagaggaaagccagtgccgcgtcccttaacctgatgagtgaactcgtctgccttaacaggtgacatacttctcccccctttgttgtcagtgacataagtaaaacaaaacaaaaaaaaaacatcgctaaaataccccttttggatcgaactcattctccttttccttcaaacagaacaagcaaaatcgtggagttcgtcaaggagctgaagaacagcgggtgcttgaacacgatgcacgttctgctggtctacctccagcaggctcctctcgtccagcacccgttagcagctaccatgctactccagctcgatctcctggtaacgtctccgccttttttttcctccttcgctcaggcgtctgttttggtattgtattgttcaaatgaagaagcttttcttgcagggtgatccttcgcagtacagcgtgtacagggaggaggcgatcgaggccatcgtagccgctctggagcacagctcgcagagcaggaaggtccaggaacagtgcgcccgagctctcctaatcttggcagggcggttctcgtcttcaggagagcccgtagcagaagcgtggctgctaaagagagcgggcctagacgattccctctctgagtccttcaggagatcagaagtattcaaagataagagtgttcgagcggtatgtacgttcagttcaaatgcccgaaaaagactacgattaaatgttcgggtttttttccctaaccgacatgtttgcttgcactgatgatgacttaggaggaagagaagctagtggaagaacggcagaagaacctcgccttgatgctactgaagagcgggggcagaaggttcctcacggcgctgtcgagctgcatatccgatggaaccccgagcctcagccggtcgtgcctcgtcagcgtggcatggatgagcagctccctctcgccgctgcgcggatgcaacgacttccagcccctggcatgctccgtcctcgcgtctaagcttttggacagcttgagctacgacagagtcctggaggagagggtgctcgcttcgctgtcgcttctgaacgtcgtgagacacccaggtacgtacgtctgcaagactggtgacagccaagtgactgtaaaaagaagaagatgaattttgttttaagagcgactgtcctaatctgacagaatgcatggagaaggtcttcccgctgaagaaagaaaccatcgagtcactccaagatctcgcggaggtgacgtggactgcgaaggagctcctctttgcctgctgcagatgagatgcaagaccagatcgtcctcagcgatgaagaactagacaccagcatgtaattggaagtgattgttttgggagaagagtgatcgccactgctgtacacagattgtttcgtacttccgttgatatgtgaagccccacagatcctttccctcgtcatggactttggctttcgctgttgaattgaagcctgcacatggcttcctttcttcttcttctttagggcttgtttagattgccaggtatccatatcaatacacatccatgtgttgtacgttaacacacaacatactatattgagttggataatgatcatccaaataagtcctt

SEQ ID NO: 322 - DNA, 3245 bp, Zea Mays
acgactcacgaattccgtcccattcccatccgcgcggacgtctcctcacgcaacctgtagccgagaccctctcacacgcttgcgatctccacctccgcggttgccggccgacctcttccccgccgcctccgccgcgcctcggggcaccggacccgtctccaacccctagatctcgcgccccctccgccccgccggccggtggtcacgccccgcctctcccgccgccggacgagctcgccgtggggcggagaggtcgccgccggcgacaggagccacgcgatgtccagggaatcctgccctttctcctcgcctcagtccttggggatccatccgtgctaatttccaccgttggtgagcaattccctagactaatttacagggggccgttcatttcgctttggtactgtactatggtttgttccgtactcgagtatgaatcattctgcaataacccacacacagcacattctcaattgatcgtgcttgccactccagttactttaatggcccagttcagcgcgacacgagttctcaaatgggtcctgtgatccatgggattctgtgtgacctgctcagagtactgctagcttgcacaagttcatttatgagcttctctgcatgctaatatccattagtaaattcagtgtgggaaaaaatgatcctctttgtggctatcttttttctttccattagaagtgaaattataatatcaggaatggaaatccgtaacagctaaaatgattgaattcttttttttattttgctctgtatttgcaggcttgcagccttttgtatcgagcatgtgctaaattgggcacgcagaaatatcatcaagtatgctgatattaccgttccgaaacatcccaacttgccagcattggtcggggtaaatttgtcaagttatcaattgaagtgtgcttggttattgatttccattaaattgcagcatagcttgctcttcatctgaaagttttcgagggtagatgtttatcgtgcaccatggtcgttggtaatgacatagttgacatggttgggtgctaaaaggacgagaagggtttgaataaacggtccgatgaacattctacttgagcttaagcatctcaagctctttagcatgcccgcaagacctgtcatctgtaaaggccttctgatagtgattgcccttattttgttgagagcaattgtatctccttttcttgctatagattcatctgagaagaaagaattttacgagtccacagcccctgacttgcttcctagaattagacgagacaagtttcttgaggtcccacagatcatatgggggttgaacaatcagaagattgcattcgccagagcatgcttgactgcaagattcctgaacagatcccttctcatgccaagcttgagtgcttctctcttctacaaagaggttgacttgctgcagcctgtcagttttgacaaagtgtttgactttaacaagttcaatgcgcgttgccatggcttcgtaaggttagctcagtattcagaagtttcaaatcggacagagcccttcaaactccaaaaggggaccggtagaaggtggacggcagacagagatttggatcaactacagcaatccataggcagcaatgtggatgactctgaagtcattgaaatcgttgggaaaaatccatttctgtggcctgaccactggccagtcaaagactatgccaaaatcttcgattgccttgtcttagttcctgagatagaaaccgaagtggtcaaggtgatatccaagattagagaggcaggccaaagagcaagacatgaagctgggggttctcatagtaagcagaggagagatagctcaacgaatccgcctgtaccgtatgttgctgttcacatgagaatagaaaaagattggatgatacattgcaagaagtgggagcagcggtccaagtcacatgaaatctgcagtagtaaagaagagatcattcataaggtctcacagatcactgacctacgtcggccggttgttgtttatcttgcggtagctgacagccttcttgaagacgattcaataaccagtgggtggagagtgggtatggttgcttacgagaagaagaagcttggtgttactgacatctacgatcgtcagccatatcttataaagtctgccatcgacttcgaggtgtgctcgagagcagacgtgtttgtcggcaacagcttctcaacattctccaacctcgtagtgctgtccaggacagaaaggctgtacaacctgggaaaggcgagctcgtgtggcgagaacatcgggctttcgtcgtatgcgtacaatgtcatgggcgacgatggtggaccacagagatggatgacagatatgtcggacacaagcctgcagaggttaagttacggaacaaataacgtctcatgccactgactttgacgcatagcaaacttgactgaacatgatgtatacctgaggaagagtccttgcccgacttcgctttttatcggcaaaggaagcaagtatgtgcagctaatttgacgtgcttctgtgttcgaagctagagcccacatgtcgcacttgtgaaggactatggccaagagtttagatgtgcttaaaagtgttgacagtgttgggcagtttgtagtttgtataacgctgaatgctgcgcgatggcttttacctgggacccttttgtttttttatggtttcagaatcagacctacacattcaagtgtattttgttcacatgcagcgtgtgtgtttttaagatggtttgctgtgttctgactttttttatttcaatcgccctcaatgcagtaaacctccttgcaaaaaggaccagatgcttgctatttctccaggtttggaactgtgtgagaaataggggttggtgggaagattatttggcgatttttttttctcttccatccgatttttatataatatgaggatagcctgtgtagcagtgagagctatctttattgagtaaccagatcatgcagtcttttcgtatttgcgggatgaagacaatgcggggtgaacacaatgcaaagtgaagattttgtttgctttatgaccattagagtttatattagagcctctggcacttctgtttttctttaaaactagaatcttgataaatgtaactgaatttctatctcctggttcaaatgtaaatgcaatgggcatcttgccctgtttaatcatttttgaagtgcgtgtagatttagctaaagtttttgacagaattgaatggaacttaattatgtctgct

SEQ ID NO: 323 - DNA, 897 bp, Zea Mays; identical to SEQ ID NO: 148

SEQ ID NO: 324 - DNA, 3363 bp, Zea Mays
gtggttcgtttagctccgtctccgtggagagcctctctcgcggataaccggtaggcactgccaaggggacggcggcgcctggtgccgtcggccagcgcggctgcgcggtgcgcgcgtctcgccgactcgatgtgccgttgcgtgttcgttcgtttcttggactacagtttcttactttctttggagaaaagtccgctgtttagaaattaagcttcggatctgaaataagcttctagattgtggaatgacgcgtcttttctgactagtagctcgcatataattctttctttacgaaaaggactccaggtggttacttgggatctacgtgctccaagaaatgagcaatagccagtaggaatccgtaagctgcgagaccaatcttcatatttactctgaaacagtatggacagtggtaaacttttttctcacgagctgcagtcataattcgagagtaacaagcagcggatgtcgtaatggttagattggatggatggatgctactagtgtagaaaccacttgatgatggttacctggtttctacccaatacccaccagttccatttagatgatggttagttcatcatccatattgttatgcattactgaactgttttttctttctcaatttgcagcctacagtcaacccattcaacctcaaatgttccttgtgaggtatcatgacagaacagcaggaaggtgttagcaagagctcttcctcaagtattagcagcagcactcaggagagtgaggaggaactgaccatcggtacccttataaccgaagcaacaaacacaacaaacagtgccaagagtcttggaaagcgcctttcacacttagattcgatcccggtactgatctcactgttgtgcaatgtttctctgataatgctggcacctctgcttccttgaagtttaccttctaaatgtaccatattttctgattggagaaaattattattgagctgtttgggttgagatagagcatgtccatgtagacttcaataaagaaaattggcaacataatagatatgtttctgcatatttatgtgaaagctttcataatcacttaatcagcatccatattgagcagttcactatgctgcaagcttaactctagcccctgtaacaatttgctgatgttcttaatggcagcacactccacgtgttaatgggaaaattccagattttaataatgcgacaattgatcatgaatcattattagaaaggtaaagtttttatggtgcacttgcttttatcctctattttcctgttaggttcatttacctcagaactttttggtgacagattaggcacttatggcttagctgaatatcaaatagaaggagatgggaattgccaggttagctttttgtatcatgtacagaattaccttttcatttgtatgaagtaaatttatcgagatatattattattactctacatcaataatctggttctctgtagattaattgatttgtgttatgcttgtcatccatttgtatcgatagacttaataggtcgtcgggagggggagtactattgcttcaatccatcttctacttagttggtagtaatttactatatcttcttcttgctaagagcaaatctgattacgatatttaggttcattgacgaggtggctttgttgtcttttacgctttctccatgttgtgctttctcttgttgcagtttcgagctctggcagaccagatattccgcaatcctgactatcacaaacatgtgaggaaggcggtagtgaagcaggtatatccacctttccctctctctttctctaaaagatctcttacctacagaattcatttattccataggaaaagtagcttgctttcctggatatgtgaatgttctgaagtactctctctctctctctctctgtttagctgaaggagttcaggaaacactatgaaggttatgtgccaatggaatataaggtttacttgaagaaaatgaaaaggttttagtctgtaacaaattcaagatgcctaattctgtcttgtgacttctttttctcatttcctgatgcatgcctttcttttatataacaccttaggtctggggaatggggtgatcatgtgaccttacaggcagctgcagacagggtaaaaaacattttatctacaggttttggcattatttatcttgtggcatctagttctagctgtacttaatagaatgcccccagataattttaagcttacactgtccattcacaaatctgtagcagttttggttgcatctaaccaaactatctacatttggtccattacatgttgagatttaaaatttggtactgttaaatttgtcactaaaagcggtatcatagtattatatttttgctacactttatagacattacaatagaatttggtgagtacaaatatatttgataccctaaatgtcacttagttgtgagttttggctggagggagaaattgtataattgtcttgtatcgtagttctcgaaaatatttctttcaaactgtttcaatagagtactaagtagttatattatcagtaggatgacatggatttgctaacagcaaccatttttatctgttaaaccagtttgctgctaaaatatgtctgttgacatcgtttagagacacatgcctagttgagatagtccccagagatgccactccaacaagaggttagagttggatcctgtcctgtcttctccagttctctgtctatatcatatatcaactatttatcctatcatcactctgaccactttggtattgtgatttcccttcattattatagagttttgttaagtttctggaatccacatgcacaatacaaggtcagtaaattttagtgtaagatttggtgcctcattatttgcttgtacctttttgcagagctttggctaagtttctggtgtgaagtacactacaattcattgtatgcagttgaaggtgaggggtttattctcttattgcttgccgatatttgatagcatgtattccaaaaaattgctgggattttttatggcatactagctcatctgacctcacactcttatcctttcagatcttccaacacggaaaactaagaagaagcattggctgttctagctcgccaggctttggtgatttcttggtatgctattggtcttctctttgtagtccagcagcatctgtaagcctgcttagttatgcctttgtttgttgtaagttgtaacttgacctggaatcaaattcatttaagatcatgcaaaatacagtgagctcttgcttcgtccttggctgaaatatttccagcacatagtaaacatgttttcagggacctattttttattttttttggggggggggggggggggtattttgcttcgtag

SEQ ID NO: 325 - DNA, 3724 bp, Zea Mays
atcccaaggtcatttcggttaatctccacacgcatcgcggacacggagacttgccttccttttggtgcggaaaaagaaagagaggagaagcgaaggaggttctcagttggagcggctccctctccccgcgcgcgccaccgcctccgatccgagcagccggtgagtctcctcagagtcctctcctccgcgcggcagcgccagttctaggctcttccggagccggaaccagagcgttcccgctggcccggatccttgggtccaccggtcccggcggcgcaaagctctactctgtttcctgttgcgtgttggatgcgtctctttccttccttagtgctccccctttcgctggtgaacgcttattgtggttcgtttagctccgtctccgtggagagcctctctcgcggataaccggtaggcactgccaaggggacggcggcgcctggtgccgtcggccagcgcggctgcgcggtgcgcgcgtctcgccgactcgatgtgccgttgcgtgttcgttcgtttcttggactacagtttcttactttctttggagaaaagtccgctgtttagaaattaagcttcggatctgaaataagcttctagattgtggaatgacgcgtcttttctgactagtagctcgcatataattctttctttacgaaaaggactccaggtggttacttgggatctacgtgctccaagaaatgagcaatagccagtaggaatccgtaagctgcgagaccaatcttcatatttactctgaaacagtatggacagtggtaaacttttttctcacgagctgcagtcataattcgagagtaacaagcagcggatgtcgtaatggttagattggatggatggatgctactagtgtagaaaccacttgatgatggttacctggtttctacccaatacccaccagttccatttagatgatggttagttcatcatccatattgttatgcattactgaactgttttttctttctcaatttgcagcctacagtcaacccattcaacctcaaatgttccttgtgaggtatcatgacagaacagcaggaaggtgttagcaagagctcttcctcaagtattagcagcagcactcaggagagtgaggaggaactgaccatcggtacccttataaccgaagcaacaaacacaacaaacagtgccaagagtcttggaaagcgcctttcacacttagattcgatcccggtactgatctcactgttgtgcaatgtttctctgataatgctggcacctctgcttccttgaagtttaccttctaaatgtaccatattttctgattggagaaaattattattgagctgtttgggttgagatagagcatgtccatgtagacttcaataaagaaaattggcaacataatagatatgtttctgcatatttatgtgaaagctttcataatcacttaatcagcatccatattgagcagttcactatgctgcaagcttaactctagcccctgtaacaatttgctgatgttcttaatggcagcacactccacgtgttaatgggaaaattccagattttaataatgcgacaattgatcatgaatcattattagaaaggtaaagtttttatggtgcacttgcttttatcctctattttcctgttaggttcatttacctcagaactttttggtgacagattaggcacttatggcttagctgaatatcaaatagaaggagatgggaattgccaggttagctttttgtatcatgtacagaattaccttttcatttgtatgaagtaaatttatcgagatatattattattactctacatcaataatctggttctctgtagattaattgatttgtgttatgcttgtcatccatttgtatcgatagacttaataggtcgtcgggagggggagtactattgcttcaatccatcttctacttagttggtagtaatttactatatcttcttcttgctaagagcaaatctgattacgatatttaggttcattgacgaggtggctttgttgtcttttacgctttctccatgttgtgctttctcttgttgcagtttcgagctctggcagaccagatattccgcaatcctgactatcacaaacatgtgaggaaggcggtagtgaagcaggtatatccacctttccctctctctttctctaaaagatctcttacctacagaattcatttattccataggaaaagtagcttgctttcctggatatgtgaatgttctgaagtactctctctctctctctctctgtttagctgaaggagttcaggaaacactatgaaggttatgtgccaatggaatataaggtttacttgaagaaaatgaaaaggttttagtctgtaacaaattcaagatgcctaattctgtcttgtgacttctttttctcatttcctgatgcatgcctttcttttatataacaccttaggtctggggaatggggtgatcatgtgaccttacaggcagctgcagacagggtaaaaaacattttatctacaggttttggcattatttatcttgtggcatctagttctagctgtacttaatagaatgcccccagataattttaagcttacactgtccattcacaaatctgtagcagttttggttgcatctaaccaaactatctacatttggtccattacatgttgagatttaaaatttggtactgttaaatttgtcactaaaagcggtatcatagtattatatttttgctacactttatagacattacaatagaatttggtgagtacaaatatatttgataccctaaatgtcacttagttgtgagttttggctggagggagaaattgtataattgtcttgtatcgtagttctcgaaaatatttctttcaaactgtttcaatagagtactaagtagttatattatcagtaggatgacatggatttgctaacagcaaccatttttatctgttaaaccagtttgctgctaaaatatgtctgttgacatcgtttagagacacatgcctagttgagatagtccccagagatgccactccaacaagaggttagagttggatcctgtcctgtcttctccagttctctgtctatatcatatatcaactatttatcctatcatcactctgaccactttggtattgtgatttcccttcattattatagagttttgttaagtttctggaatccacatgcacaatacaaggtcagtaaattttagtgtaagatttggtgcctcattatttgcttgtacctttttgcagagctttggctaagtttctggtgtgaagtacactacaattcattgtatgcagttgaaggtgaggggtttattctcttattgcttgccgatatttgatagcatgtattccaaaaaattgctgggattttttatggcatactagctcatctgacctcacactcttatcctttcagatcttccaacacggaaaactaagaagaagcattggctgttctagctcgccaggctttggtgatttcttggtatgctattggtcttctctttgtagtccagcagcatctgtaagcctgcttagttatgcctttgtttgttgtaagttgtaacttgacctggaatcaaattcatttaagatcatgcaaaatacagtgagctcttgcttcgtccttggctgaaatatttccagcacatagtaaacatgttttcagggacctattttttattttttttggggggggggggggggggtattttgcttcgtag

SEQ ID NO: 326 - DNA, 3724 bp, Zea Mays; identical to SEQ ID NO: 325

SEQ ID NO: 327 - DNA, 3724 bp, Zea Mays; identical to SEQ ID NO: 325

SEQ ID NO: 328 - DNA, 3724 bp, Zea Mays; identical to SEQ ID NO: 325

SEQ ID NO: 329 - DNA, 1812 bp, Zea Mays
atcccaaggtcatttcggttaatctccacacgcatcgcggacacggagacttgccttccttttggtgcggaaaaagaaagagaggagaagcgaaggaggttctcagttggagcggctccctctccccgcgcgcgccaccgcctccgatccgagcagccggtgagtctcctcagagtcctctcctccgcgcggcagcgccagttctaggctcttccggagccggaaccagagcgttcccgctggcccggatccttgggtccaccggtcccggcggcgcaaagctctactctgtttcctgttgcgtgttggatgcgtctctttccttccttagtgctccccctttcgctggtgaacgcttattgtggttcgtttagctccgtctccgtggagagcctctctcgcggataaccggtaggcactgccaaggggacggcggcgcctggtgccgtcggccagcgcggctgcgcggtgcgcgcgtctcgccgactcgatgtgccgttgcgtgttcgttcgtttcttggactacagtttcttactttctttggagaaaagtccgctgtttagaaattaagcttcggatctgaaataagcttctagattgtggaatgacgcgtcttttctgactagtagctcgcatataattctttctttacgaaaaggactccaggtggttacttgggatctacgtgctccaagaaatgagcaatagccagtaggaatccgtaagctgcgagaccaatcttcatatttactctgaaacagtatggacagtggtaaacttttttctcacgagctgcagtcataattcgagagtaacaagcagcggatgtcgtaatggttagattggatggatggatgctactagtgtagaaaccacttgatgatggttacctggtttctacccaatacccaccagttccatttagatgatggttagttcatcatccatattgttatgcattactgaactgttttttctttctcaatttgcagcctacagtcaacccattcaacctcaaatgttccttgtgaggtatcatgacagaacagcaggaaggtgttagcaagagctcttcctcaagtattagcagcagcactcaggagagtgaggaggaactgaccatcggtacccttataaccgaagcaacaaacacaacaaacagtgccaagagtcttggaaagcgcctttcacacttagattcgatcccggtactgatctcactgttgtgcaatgtttctctgataatgctggcacctctgcttccttgaagtttaccttctaaatgtaccatattttctgattggagaaaattattattgagctgtttgggttgagatagagcatgtccatgtagacttcaataaagaaaattggcaacataatagatatgtttctgcatatttatgtgaaagctttcataatcacttaatcagcatccatattgagcagttcactatgctgcaagcttaactctagcccctgtaacaatttgctgatgttcttaatggcagcacactccacgtgttaatgggaaaattccagattttaataatgcgacaattgatcatgaatcattattagaaaggtaaagtttttatggtgcacttgcttttatcctctattttcctgttaggttcatttacctcagaactttttggtgacagattaggcacttatggcttagctgaatatcaaatagaaggagatgggaattgccaggttagctttttgtatcatgtacagaattaccttttcatttgtatgaagtaaatttatcgagatatattattattactctacatcaataatct

SEQ ID NO: 330 - DNA, 3416 bp, Zea Mays
cgctgtggttggccaatcctgacacattatcttctcatccaagccgagagcgtgaccagctcacccagatcagaatccagacctcgtcagagagcattcccttgtgcatctcggcctctccttcctcccttcctcgcccgcccagtcctctaaccatcttctccaaacgcccggagatggtctcgctgcgatgcaccaccgcgcaccactccctcctcggctcgccgacctgcctcgcgcgcccgcggcggcggccgtgccccgtcgtgcgcgctgccgtcgccgtggaggccggcgctcaggccaaggtctcactcatccggattgggacgcgtgggaggtgatcgaattcgaccctttctgcggtttctttgtttgggatgacgatgaattcgtggttatgctggtcaaaatcgtgtctttaggttctgttaattgttgaatttggggacggcaatgcgttgtgacttgtgagtgcctgatagatcctgcgtttagctcttcgtccgggaatgtgagttttgagatgtggctctgaacctactgcgtctttattaggtgttgaacattgtggattgtctggtaaagttcaaaggagcatcgagaatcgttagcaggaaggatgcgcttctttgctttgtaggatgcaattccgaatcagtagtaactgggcgttgaccttgatagagctaaagaatggcggcaaaattctacgttttagatctcacctctgctatttttgggccaacaccagaggctggattgttcttgtgctattctcatgctagttagtggtttcatgttagcgtttacaagggtgttgtctttatcagtctttgccttgactcggttttaaccaatttactacttttcttggatcttgtggaaattctacgccttttagacattttccttatgttgagaaaaaagttactcaagaattcgttttaaaaagcagcaagaaaaagttactaaagaaaattcacagttgctgccaaaacaaattgttcattccactttccaagttttcattttaaagtgttgtttgtttctttttttcatttggaatgtgcaaattttgtaattcttgtcattggttatttaggacagtcctctggctcttgcacaagcccatgaaactcgggaaaaactgaaagccgcacactctgagttagctgaggagggggctattgagatcgtcatcataaagaccacaggagacatgatcttggacaaaccccttgcagatattggaggcaagggtttattcaccaaggagatagatgatgcactcttgcagggaaggattgatatagctgtgcactctatgaaagatgttccaacatatctacctgaaggcacaatattgccctgtaacctcccacgagaagatgtaagagatgcattcatatgcttgactgcaaattcgctcgcggagcttcctgctggcagtgttgttggaagtgcttccttgcggagacaatctcagattctctacagatatccatcactgaaagtaagtatgatggttttgctcatcacactttccctcctcaccccctatacttgtgattttagtgctaccagatttactgatgtgttcataggtacttcccagtattgtgagtccggtgtcccccccccccccccattgcatactctctgaagtctagaacatagatcttctttctatcagctgcagtttttaactctattataaactgttaaaaaaactcttaccaatatgtacatttttcatttgtatgattctgaagctgttgttttcaatgtcatacatgtgaaaaaatgtccatcctagaggcattattgcaattttctttttcttttgttataaagagtattttgtccggttgacagttgtatattcttgccttagtcctgtacttaaatatttagaagcctgtatctgtatttttaaaaaaatatttagaagtgtgttatgattaggcattgaccttgattagtctcgcttaagtaacagtattcaatgttttgcaggtagttaacttcagaggaaatgttcagacacggttaaggaaactcaaggaaggagatgtgtctgctacattgttggcgctggctggattaaggcggctaaaaatggcagaaaatgcaacagctgtactatcagtggaagaaatgcttccggcagttgcccaaggtgctattggaatcgcttgccgaagcaacgatgacaaaatggtaaggcgtccagtgttgcagtatgctggtaaatggagaaaacatgatgcttgcatgattccatgtacaaatctgacactagctttgctgtcttttctttatcggactttgcatgccactttgattaactgataagcaagggcggatctagaattaggaaccattgatgtcgctagcgtagctatgatggacatgctgtgtcattgccccttttgcccacagtaatttttcattgagtttacacaggtcattgctgtcaggggacagaattactaatactgtggacctgccccctggtgacagggtctgaccattttatggtcctgaataataaccattctaggtatatatattgctgttgaggccacacagatatgtctctttgtcatgccactatttgcatttttatttaacaaatatcttttatttattgctttttttatcatggccatgttgcatgctgtggcttttccgaaagcatttaatctttgcaactatgccttacagtaggcctttatttttcttatttcagagtgtgcattgttgttttattccgcaatgtacatgaatgtactatgcagctacgcagagcatggcaggcacttgcttgctcatggctttctttttaacactatatgtatccgaaaatgataagatctgccattctttgccctcttttctgcagatggagtatctgtcctcgttgaaccacgaggataccagactagctgtcacatgcgaaagagaattcttggcagttcttgatggcaactgccgaactccaattgcggcctatgcttaccgtgacaaggacgggaactgctcattccggggcctactgtcttcaccagacggatctaaaggtatcctcgattttcgatcgagaggatcttaaaatggtcctgttctgtttgtcatcgaatgacatcgctttgttgcttgcgtggttcttcttgcagtatttgagacggcaagaagtggaccgtactctttcgacgacatggtcgagatgggcaaagacgctggccacgagctgaaggcgaaggctgggcctggcttcttcgatagccttcaatgaacagaatgtgcggccatgcgcgatttcagttggcaccctttcggttgaaaacgagggccaaagtaggttgttgaggggtttgtttttgtttcttctttttttctcctactactag

SEQ ID NO: 331 - DNA, 3961 bp, Zea Mays
cgctgtggttggccaatcctgacacattatcttctcatccaagccgagagcgtgaccagctcacccagatcagaatccagacctcgtcagagagcattcccttgtgcatctcggcctctccttcctcccttcctcgcccgcccagtcctctaaccatcttctccaaacgcccggagatggtctcgctgcgatgcaccaccgcgcaccactccctcctcggctcgccgacctgcctcgcgcgcccgcggcggcggccgtgccccgtcgtgcgcgctgccgtcgccgtggaggccggcgctcaggccaaggtctcactcatccggattgggacgcgtgggaggtgatcgaattcgaccctttctgcggtttctttgtttgggatgacgatgaattcgtggttatgctggtcaaaatcgtgtctttaggttctgttaattgttgaatttggggacggcaatgcgttgtgacttgtgagtgcctgatagatcctgcgtttagctcttcgtccgggaatgtgagttttgagatgtggctctgaacctactgcgtctttattaggtgttgaacattgtggattgtctggtaaagttcaaaggagcatcgagaatcgttagcaggaaggatgcgcttctttgctttgtaggatgcaattccgaatcagtagtaactgggcgttgaccttgatagagctaaagaatggcggcaaaattctacgttttagatctcacctctgctatttttgggccaacaccagaggctggattgttcttgtgctattctcatgctagttagtggtttcatgttagcgtttacaagggtgttgtctttatcagtctttgccttgactcggttttaaccaatttactacttttcttggatcttgtggaaattctacgccttttagacattttccttatgttgagaaaaaagttactcaagaattcgttttaaaaagcagcaagaaaaagttactaaagaaaattcacagttgctgccaaaacaaattgttcattccactttccaagttttcattttaaagtgttgtttgtttctttttttcatttggaatgtgcaaattttgtaattcttgtcattggttatttaggacagtcctctggctcttgcacaagcccatgaaactcgggaaaaactgaaagccgcacactctgagttagctgaggagggggctattgagatcgtcatcataaagaccacaggagacatgatcttggacaaaccccttgcagatattggaggcaagggtttattcaccaaggagatagatgatgcactcttgcagggaaggattgatatagctgtgcactctatgaaagatgttccaacatatctacctgaaggcacaatattgccctgtaacctcccacgagaagatgtaagagatgcattcatatgcttgactgcaaattcgctcgcggagcttcctgctggcagtgttgttggaagtgcttccttgcggagacaatctcagattctctacagatatccatcactgaaagtaagtatgatggttttgctcatcacactttccctcctcaccccctatacttgtgattttagtgctaccagatttactgatgtgttcataggtacttcccagtattgtgagtccggtgtcccccccccccccccattgcatactctctgaagtctagaacatagatcttctttctatcagctgcagtttttaactctattataaactgttaaaaaaactcttaccaatatgtacatttttcatttgtatgattctgaagctgttgttttcaatgtcatacatgtgaaaaaatgtccatcctagaggcattattgcaattttctttttcttttgttataaagagtattttgtccggttgacagttgtatattcttgccttagtcctgtacttaaatatttagaagcctgtatctgtatttttaaaaaaatatttagaagtgtgttatgattaggcattgaccttgattagtctcgcttaagtaacagtattcaatgttttgcaggtagttaacttcagaggaaatgttcagacacggttaaggaaactcaaggaaggagatgtgtctgctacattgttggcgctggctggattaaggcggctaaaaatggcagaaaatgcaacagctgtactatcagtggaagaaatgcttccggcagttgcccaaggtgctattggaatcgcttgccgaagcaacgatgacaaaatggtaaggcgtccagtgttgcagtatgctggtaaatggagaaaacatgatgcttgcatgattccatgtacaaatctgacactagctttgctgtcttttctttatcggactttgcatgccactttgattaactgataagcaagggcggatctagaattaggaaccattgatgtcgctagcgtagctatgatggacatgctgtgtcattgccccttttgcccacagtaatttttcattgagtttacacaggtcattgctgtcaggggacagaattactaatactgtggacctgccccctggtgacagggtctgaccattttatggtcctgaataataaccattctaggtatatatattgctgttgaggccacacagatatgtctctttgtcatgccactatttgcatttttatttaacaaatatcttttatttattgctttttttatcatggccatgttgcatgctgtggcttttccgaaagcatttaatctttgcaactatgccttacagtaggcctttatttttcttatttcagagtgtgcattgttgttttattccgcaatgtacatgaatgtactatgcagctacgcagagcatggcaggcacttgcttgctcatggctttctttttaacactatatgtatccgaaaatgataagatctgccattctttgccctcttttctgcagatggagtatctgtcctcgttgaaccacgaggataccagactagctgtcacatgcgaaagagaattcttggcagttcttgatggcaactgccgaactccaattgcggcctatgcttaccgtgacaaggacgggaactgctcattccggggcctactgtcttcaccagacggatctaaaggtatcctcgattttcgatcgagaggatcttaaaatggtcctgttctgtttgtcatcgaatgacatcgctttgttgcttgcgtggttcttcttgcagtatttgagacggcaagaagtggaccgtactctttcgacgacatggtcgagatgggcaaagacgctggccacgagctgaaggcgaaggctgggcctggcttcttcgatagccttcaatgaacagaatgtgcggccatgcgcgatttcagttggcaccctttcggttgaaaacgagggccaaagtaggttgttgaggggtttgtttttgtttcttctttttttctcctactactagttcctgctagagccttgtactaccactcatgttgagcagccccattcagcttttgttgtttctcatgttcttttagcactctgggttagagagagccggtatctgcacagctatgttgtgtcgaagttgatgtgactctgcagatagttgttgtttcaagaatatttgagcgagctcatgataaccatgggagtaagattcgatgttcctattcttcggaaaattagccttgttgattgattctcagatgaacctgatgaatgtcacatccctctttgggggaaatgagaatggagaaacctgcctctttcatgaatgtcacatacacccctaaatgttccagtttttttttttaaaaaaattaaacaaatatgattcctttttattattattttctgcaatcacatagaggcaagatgaacacaaaggcaacaccggcactctttcacaatattggagataactgatagtctgatacaggtcccaatctaaattacccagacattttcagatgctactgaacaaggatctcctgaagcatctta

SEQ ID NO: 332 - DNA, 3957 bp, Zea Mays
gtggttggccaatcctgacacattatcttctcatccaagccgagagcgtgaccagctcacccagatcagaatccagacctcgtcagagagcattcccttgtgcatctcggcctctccttcctcccttcctcgcccgcccagtcctctaaccatcttctccaaacgcccggagatggtctcgctgcgatgcaccaccgcgcaccactccctcctcggctcgccgacctgcctcgcgcgcccgcggcggcggccgtgccccgtcgtgcgcgctgccgtcgccgtggaggccggcgctcaggccaaggtctcactcatccggattgggacgcgtgggaggtgatcgaattcgaccctttctgcggtttctttgtttgggatgacgatgaattcgtggttatgctggtcaaaatcgtgtctttaggttctgttaattgttgaatttggggacggcaatgcgttgtgacttgtgagtgcctgatagatcctgcgtttagctcttcgtccgggaatgtgagttttgagatgtggctctgaacctactgcgtctttattaggtgttgaacattgtggattgtctggtaaagttcaaaggagcatcgagaatcgttagcaggaaggatgcgcttctttgctttgtaggatgcaattccgaatcagtagtaactgggcgttgaccttgatagagctaaagaatggcggcaaaattctacgttttagatctcacctctgctatttttgggccaacaccagaggctggattgttcttgtgctattctcatgctagttagtggtttcatgttagcgtttacaagggtgttgtctttatcagtctttgccttgactcggttttaaccaatttactacttttcttggatcttgtggaaattctacgccttttagacattttccttatgttgagaaaaaagttactcaagaattcgttttaaaaagcagcaagaaaaagttactaaagaaaattcacagttgctgccaaaacaaattgttcattccactttccaagttttcattttaaagtgttgtttgtttctttttttcatttggaatgtgcaaattttgtaattcttgtcattggttatttaggacagtcctctggctcttgcacaagcccatgaaactcgggaaaaactgaaagccgcacactctgagttagctgaggagggggctattgagatcgtcatcataaagaccacaggagacatgatcttggacaaaccccttgcagatattggaggcaagggtttattcaccaaggagatagatgatgcactcttgcagggaaggattgatatagctgtgcactctatgaaagatgttccaacatatctacctgaaggcacaatattgccctgtaacctcccacgagaagatgtaagagatgcattcatatgcttgactgcaaattcgctcgcggagcttcctgctggcagtgttgttggaagtgcttccttgcggagacaatctcagattctctacagatatccatcactgaaagtaagtatgatggttttgctcatcacactttccctcctcaccccctatacttgtgattttagtgctaccagatttactgatgtgttcataggtacttcccagtattgtgagtccggtgtcccccccccccccccattgcatactctctgaagtctagaacatagatcttctttctatcagctgcagtttttaactctattataaactgttaaaaaaactcttaccaatatgtacatttttcatttgtatgattctgaagctgttgttttcaatgtcatacatgtgaaaaaatgtccatcctagaggcattattgcaattttctttttcttttgttataaagagtattttgtccggttgacagttgtatattcttgccttagtcctgtacttaaatatttagaagcctgtatctgtatttttaaaaaaatatttagaagtgtgttatgattaggcattgaccttgattagtctcgcttaagtaacagtattcaatgttttgcaggtagttaacttcagaggaaatgttcagacacggttaaggaaactcaaggaaggagatgtgtctgctacattgttggcgctggctggattaaggcggctaaaaatggcagaaaatgcaacagctgtactatcagtggaagaaatgcttccggcagttgcccaaggtgctattggaatcgcttgccgaagcaacgatgacaaaatggtaaggcgtccagtgttgcagtatgctggtaaatggagaaaacatgatgcttgcatgattccatgtacaaatctgacactagctttgctgtcttttctttatcggactttgcatgccactttgattaactgataagcaagggcggatctagaattaggaaccattgatgtcgctagcgtagctatgatggacatgctgtgtcattgccccttttgcccacagtaatttttcattgagtttacacaggtcattgctgtcaggggacagaattactaatactgtggacctgccccctggtgacagggtctgaccattttatggtcctgaataataaccattctaggtatatatattgctgttgaggccacacagatatgtctctttgtcatgccactatttgcatttttatttaacaaatatcttttatttattgctttttttatcatggccatgttgcatgctgtggcttttccgaaagcatttaatctttgcaactatgccttacagtaggcctttatttttcttatttcagagtgtgcattgttgttttattccgcaatgtacatgaatgtactatgcagctacgcagagcatggcaggcacttgcttgctcatggctttctttttaacactatatgtatccgaaaatgataagatctgccattctttgccctcttttctgcagatggagtatctgtcctcgttgaaccacgaggataccagactagctgtcacatgcgaaagagaattcttggcagttcttgatggcaactgccgaactccaattgcggcctatgcttaccgtgacaaggacgggaactgctcattccggggcctactgtcttcaccagacggatctaaaggtatcctcgattttcgatcgagaggatcttaaaatggtcctgttctgtttgtcatcgaatgacatcgctttgttgcttgcgtggttcttcttgcagtatttgagacggcaagaagtggaccgtactctttcgacgacatggtcgagatgggcaaagacgctggccacgagctgaaggcgaaggctgggcctggcttcttcgatagccttcaatgaacagaatgtgcggccatgcgcgatttcagttggcaccctttcggttgaaaacgagggccaaagtaggttgttgaggggtttgtttttgtttcttctttttttctcctactactagttcctgctagagccttgtactaccactcatgttgagcagccccattcagcttttgttgtttctcatgttcttttagcactctgggttagagagagccggtatctgcacagctatgttgtgtcgaagttgatgtgactctgcagatagttgttgtttcaagaatatttgagcgagctcatgataaccatgggagtaagattcgatgttcctattcttcggaaaattagccttgttgattgattctcagatgaacctgatgaatgtcacatccctctttgggggaaatgagaatggagaaacctgcctctttcatgaatgtcacatacacccctaaatgttccagtttttttttttaaaaaaattaaacaaatatgattcctttttattattattttctgcaatcacatagaggcaagatgaacacaaaggcaacaccggcactctttcacaatattggagataactgatagtctgatacaggtcccaatctaaattacccagacattttcagatgctactgaacaaggatctcctgaagcatctta

SEQ ID NO: 333 - DNA, 978 bp, Zea Mays
aatacaacaacagcagcagcagcagtcttttagcccaagtaagttagggtaggctagagctgaaactcaatagaaaccacaagtcaaggttcaaagttcaaacacattttgggtttcacctttattaaaatagctagctttaacatgggctggacaaacctatcaggctatcacaaccctcctcctgttcctccctttccacaagttcgagtggtaacaatctgtcattctatatcttcagtagaaactgtgaattcaacagaagtactgcagtttgaccatgtttatgatgcttttaacattctctgtaggttatgtattggagaagagtcgcggacagaattcagatgctgaagtcagcaattttacatcccgagctgaattccagagcataacctactggaatcacgatacagcgccatcagcagaggattccctcccgaggtgcttccattggcttaccgtcgctaatgcggtgagcattatttcttcacctaacgatctgtttgttttccatttacgcaaatttgttttgcttccgccgcatcaacttgttgtggttagctatatgcagtaggccacataaatcaataatcactgaaacaaaggaagtgtcatcacatagactgacagacatgatcctaattttggcttcctgtttgtacagatgcatagagcagtgactgctgaagacctgactaacatggcagcaatgcagaatcaggacaagtagattcgttctataacgaagccatgcaatttcgatttggtgaaccatctcgacaaaggatcttgtaacaaccaacatgttatttgaacgcatccagtaggtaatgtttaggctttggggtaagatgcttcaggagatccttgttcagtagcatctgaaaatgtctgggtaatttagattgggacctgtatcagactatcagttatctccaatattgtgaaagagtgccggtgttgcctttgtgttca

SEQ ID NO: 334 - DNA, 2156 bp, Zea Mays
gtttttcttcctgtggtcgctcgttgagtgcggaaattccacgaacgtgagctcaacatggagccggcgacccctccggcacccgccgccggcgtcacggctaccgtcgacctctcctcagtcgcagccgacctcggtggggcgcacctcctgccctgcggcatcaggcagaacggcggcgcccccgtatccgactacttcaagcctagggacacaggtccgtgcccacccccgagtcaaatctctcgtttcctttttcccgctcatttagttgaggaattggtgtgggcctcccgataggtgtggaggtggagggggtgaagatggaagaggccttctttcgtgggaggaaactgcagggcactaccctagctctcccggatggctaccgaggttacatcactttcttccttctgccttcttcaagcctacaagatttctgagtttatcatcagtttgggacctttggagtgggaagcgtgttttttctcctttttcttcatcgattcgtagcaatgtacgttgatttatggcctgaatgatagtgaagctgtatagaatcagtgtaaccgtaactagatgcgccaaaatccgacattctctccaaattgcatgcacgcctttaaggtgactggatgaattgtgtggcgctgataaaaaccgaaactttatgggggaacattgatattccagccgtcctaaaaaaaggcaccttcaaattctagtaagaattaatttatgattcaaatgcatgctgaaaaagtataaacactatgaagtaaggaagtcgttcacaaatcctgaagtttcagttttgagtttggctgcagaagtgatcattgaatggcggtgtattccttcttttacctgaaatatggccatcggcctacttagtacatatgttaattggtcttgggatgctaagtttgcatgtacatctagatgtgtggagatgataggtggtgaccagaggtaacaatctattttttttttcaataaaaggagctcggccattcaattaagtaagaaaagagagattttatgtacagaatgcacccttggtgccaaacacatcggtcattagggccgaaggctaacaaaccccctcgaaccgaagacaggtttcgaccataaataatgtcgctttatgcctctgaactatcctttttgagtgatacaatacaacaacagcagcagcagcagtcttttagcccaagtaagttagggtaggctagagctgaaactcaatagaaaccacaagtcaaggttcaaagttcaaacacattttgggtttcacctttattaaaatagctagctttaacatgggctggacaaacctatcaggctatcacaaccctcctcctgttcctccctttccacaagttcgagtggtaacaatctgtcattctatatcttcagtagaaactgtgaattcaacagaagtactgcagtttgaccatgtttatgatgcttttaacattctctgtaggttatgtattggagaagagtcgcggacagaattcagatgctgaagtcagcaattttacatcccgagctgaattccagagcataacctactggaatcacgatacagcgccatcagcagaggattccctcccgaggtgcttccattggcttaccgtcgctaatgcggtgagcattatttcttcacctaacgatctgtttgttttccatttacgcaaatttgttttgcttccgccgcatcaacttgttgtggttagctatatgcagtaggccacataaatcaataatcactgaaacaaaggaagtgtcatcacatagactgacagacatgatcctaattttggcttcctgtttgtacagatgcatagagcagtgactgctgaagacctgactaacatggcagcaatgcagaatcaggacaagtagattcgttctataacgaagccatgcaatttcgatttggtgaaccatctcgacaaaggatcttgtaacaaccaacatgttatttgaacgcatccagtaggtaatgtttaggctttggggtaagatgcttcaggagatccttgttcagtagcatctgaaaatgtctgggtaatttagattgggacctgtatcagactatcagttatctccaatattgtgaaagagtgccggtgttgcctttgtgttca

SEQ ID NO: 335 - DNA, 628 bp, Zea Mays
gtttttcttcctgtggtcgctcgttgagtgcggaaattccacgaacgtgagctcaacatggagccggcgacccctccggcacccgccgccggcgtcacggctaccgtcgacctctcctcagtcgcagccgacctcggtggggcgcacctcctgccctgcggcatcaggcagaacggcggcgcccccgtatccgactacttcaagcctagggacacaggtccgtgcccacccccgagtcaaatctctcgtttcctttttcccgctcatttagttgaggaattggtgtgggcctcccgataggtgtggaggtggagggggtgaagatggaagaggccttctttcgtgggaggaaactgcagggcactaccctagctctcccggatggctaccgaggttacatcactttcttccttctgccttcttcaagcctacaagatttctgagtttatcatcagtttgggacctttggagtgggaagcgtgttttttctcctttttcttcatcgattcgtagcaatgtacgttgatttatggcctgaatgatagtgaagctgtatagaatcagtgtaaccgtaactagatgcgccaaaatccgacattctctccaaattgcatgcacgcctttaagg

SEQ ID NO: 336 - DNA, 780 bp, Zea Mays; identical to SEQ ID NO: 161

SEQ ID NO: 337 - DNA, 1860 bp, Zea Mays
atggcggccacacacgccttctatcttttctatctactggtgaggccactcctggttggtcaactagcaaatttattaaccgtgtggtcgctacctagcctaccccactagttatcctcaatcgcttggcttggagtgtagatgcaggggatgagctacgtcatgctgtcatgcctgtggtttggttgcaagatctccagatcatgtgcggatgtattgcaggtcccatgtatttctaatgatactcaacatgtgatctggtacaggggtacttaagcagtagaatttatgtgtgtctctcatcatggggtttaattacggtctggtaggtctactggagtggagtttgaaatgacactaaccaactttgttatagtgttttttttcattatttgttataacttttgtagttataacaatctgtccatccctatgttgtgcccggtagatgttgatttaggaactataggattaaggtaaattattcatttattgtcacaatttgctttgtgtagtcaccaaaggaacttgttaatgattttgcataatgttttgggacaggaaatactaaactggttgtggcatgaggagggaaccatcaacatcagttggggacctgcctcctatagggaggtaaccatactaccgtgccattgtaattttgtacatgcatttgtttttggcgttagatatttagatgcgagtgtgacatattacttcaaaattgttaggccaatctcttattcgcagcaggcatcaggttggtccgctggtgatcatttcagtttatatgtaaatgtgttgttataaatgttgaacatcggagcatgaggagggcaccattagcatcagttgggaacctgcctcctatggggaggtaagcatactattatgccattgtaattttgtacatgtatttgtttttttgcattggatatttagatgcgagtgcgacattactttgaaattgccaaaccaatctcttcatcgcagtaggcatcaggtttgtgcaccgatgatcgttctagtttacgatatgtaactctgttgttttaaattcccaaacaagtgcaattcatggttccctattgtaccatgtgatttatatatctttatacaagtctcaaatcactgtgcttattagcaaggcatatattgtgtgtctcatctatgaattgtgatcgaatttcatatatgaggatgatgagttcaaaacttgatccgtcactaaatgttgaacattggagcatgaggagggcaccatcagcatcagttgggaacgtacctgcatcctatggggaagtaagcatactgttgtgccattgtaattttgtacatgtattttattttggcatcaaatgatgcgaacgtgacatattactttgaaattgttaggccaatctcttcttcgcagcaagcattaggtttgtgtaatattgattgttttagtttatgatatgtaactgtgttgttctatactgaacatcagagcatgaggagggtaccatcatcatcatagactcaaacctacccccctatggggaggtaggcataatgttgtgccattgtaatttgtacaagtatttgtttttggcatcagatatttagatgcgagtgtgacatattactttgaaattgctaggccaatatcttcttcacattaggcatcagttttgtgcactggtgatcgtttccggtctatgatatgtaattgtgttgttagcagtgattcaattgataggttgatcaaccaaactcaatttgaagtcgcccctgcccacatccgcgtggatgttcattgctggcccgcatgacctctccaccctcttttgggtgcggtcccccaagaagtggttatga

SEQ ID NO: 338 - DNA, 228 bp, Zea Mays; identical to SEQ ID NO: 163

SEQ ID NO: 339 - DNA, 650 bp, Zea Mays
ccctccctgtccgtggatgcagcagcacctccctccctctctgctcgtgcgcaggaaacccctcacgcacagggaagaacaacagcccaccctccaaaacaccaagcagcggcagcaacctccatggcgcccctgcttccatcccatagttgagcgcccttgctgttctcttcaatgccccttggatgttcgacggaatacccgtgagaaataatgtgttgtgcgcagccccgtccgtgatgccgtcgaccctcggtgagaaccacgttgtcctcgctgttttttcggcgtttatgatgttcaaggaactgtcgtcaacaatgttttgtgttatcgcagctagtggtcgacgccgcgcttcgcgcttggcccgttcgacgaaacgccaagccttgtggacagcccatgtgactagcctcgattcgtctaggttgttcacttggtattttgtggattaatctatttaagctttggtcgatgttgtgcatgtgtgtatgtgtaagaaaatgtattggtatggattgaagttcgtggcgaaagaaaaagaagtagaaaagaactcggaggtttttatatttcgataggaatttatgcgatgtgttgtttgatgtgtgtgatttgtagtttgtataattatatttttgtcgata

SEQ ID NO: 340 - DNA, 3084 bp, Zea Mays
cgaccagagccagtccgctccgctccaccccttgctcacctccgcgacccgcaccaatggcgacgcccacggccccatcccacttacccctcgccaccgcctccgcgtccacctccttccccgaccgcttcctccgcacgccgtgcgcgctgcggccccgctcttggccccgcctgcgggcgggctccgtcaaggagtggcgcgagttcgaggacgacgcgggcgccgtcaaggagtggcgggagttcgaggacgccgtcaggaggaaggacctcccccgcgcgctccaattcctgcagtccgtggagcccgcggcggtgcaggtcgcggtccccgtgccgccggggcgggactgggaggtgctcgacgcctgcgtcgacgccgacgacatgcgcctcgtcggccgggcgtaccagttcctcgtcgaccgcggggtcctcgccagcttcggcaagtgcaagaacatcggtgagttggggcttgggggaacgcagctgcggaatgccttcacgatttggacatggcgtcgaattaacttggcgtcttactagttgtttgtcaaacggagctgtacaatttggcatgtgctgatttgattgatataatcatttgctatcacgcctcacgattttttgatgtttatcatgtaacgtctactgtgttatacagctgatgtctcactccgactgcttttcagactgactgtatatgtgtcttccttttttttccctacagttctggaatggccaagagaagtgacaccaacggttttgaaggagatgaccggtttggaaggtgaggatacagacagtgtccctgtcccctctcttccactgcgctgtgatattctacactaaaaatttgagtgggttgtcagttattacatagcaggaagttaaggcagaacctcttctttccttttattatttattaatctaaaacgggaaaactttactgcaacattcttttgcaaatcatactcgagcaagctgatatagctgctccaaaaggaactttagctcgtctattgtggtttatcaccaactatggtataaagatacgatttttttcttgaatttgttaatttcttcagctgaaaaacttgcgccgaagaaatggggtctgtcgggaagttcaccgtatgttctcattggatttcttggaggcgtatcctttctactaacacaaggggtcgatctacggcctaaactgagtgctgtattgggattagcagcagccgatgcaatgttgctcggtggtacttgtcttgctcaaatctcatgtttctggcctccgtataaacgtcggatccttgtacacgaagcaggccatcttcttactggtatggctttaccttttgtacctttttgctcttacattagttgctttcgctttaacttctccggtaggtagttttaaatttatcaatcttctgtgattctacttcagtaatgttcttacttcctttctacttatttctagcttatctaatgggctgcccgatacgaggagtcattttggatccatttgtggcattgcgaatgggcatccagggccaggtacaactattgttatcttgatactacggctatctatctgttctgtttggttgtctaatttgtaatttctgtcccttcaaaacctcaccacaccttctgaggactaggtctcgatatccattttcgcaaaagatctttttctgttctgcgagactgtctctctccctctctcctatcctccccctctcttcaataacaaaaatgtgataaatgatgtgttacatattttttattaggtttgatattatccttaaaaaatgaaatcacatgtcctgttttttcacttggcacagcgtactacacttgtagatcattagattttatggctttgcattgtacacttgtagataattagacatttagaccattagatttgtagctgttatacaactcccatgggtgtgctttggtacctctgcaggcagggactcaattctgggatgaaaagatggaaaaagaactagctgagggccatctatcaagcacagcgtttgacaggtacataaacagctatctggtctgaatattggcgattgcagttcttggacctcatttgacctgcgaaatttggagacggacggcaggtactgcatgattatgttcgccggaattgctgctgaggcacttgtttacggggaggcagaaggtggagaaaacgacgagaacttattcaggagtctgtgcattctactgaacccaccccctgctgttgcacaggtccatattattttgctgttatcttgcatgtcgtgcttatttctgaatagaccaccttatatgattgatcggtgtctcttcactgcttatcagatggcgaaccgagctcgatggtccgtcatgcagtcttacaacctcctgaagtggcacaagaaagctcatagagccgcagtcaaggcgctggaagacgggcacagtctcagcgttgtgatcagaaggatagaagaagccatcgcttctgacagcaaataaatatgaccgttgatcctttacatgtgttcttgtcaaccaagctttgttggcagcttccacaggacgcggaagaaggagaactttcttaattcgcgcgaagggttagtgtgtgttggaacatgagtggcgcttttcaaagaaagaaaggcagaagatccttggagctggagggaatagcggagaccacgaccagggcgtctgatggacggactagatcgagtgatacatccgttggagattttaaggaagtcaaaaggccgttgtgaacttgtgattagtgtcgatgccagatatggcagatgtgcatagggagatatgactatatgatgtcttgatgagtatgcagacatgagctattttgcaatggatggataagtaccgttggtacttgaggtacttttattgtttattatttatttatttgcaatcagtttggtaattaagaaaggtcgggttgcctatttgagctgccgtccggcgtccgctagagatggatactgcatatccgaattatagaataaatttaatattatatatgtatatatatatatataat

SEQ ID NO: 341 - DNA, 1277 bp, Zea Mays; identical to SEQ ID NO: 166

SEQ ID NO: 342 - DNA, 3007 bp, Zea Mays
ccgtccgatccctgctactccgcagcgctaaaagctgcagctgcaggtcagcaaccagttggagccaaaacaatggtcgaggccgccggagcggaggccacgagacgagaccggggacgatcgatagcaggccacctccatctggccgttgcctttccaacacatcggtttcccttccagaaccttcccaccctcccattccaaaaccatcgaatccgcgccgtccattaccaatccgcgggcccaggaaacccgcaggcgccgctcttacccccttcccaagccacaccgttcccccgccgccaccaggtcccaccaagcgcggcccccgcgtgtcaggcgcacaaacagccacacaccgcccgtgtggctgcgtccggctgtctgtctataaagaaaaacagaccgtccattcgatcgcctcacccgaagcacatcccgtcgcatcccatcccactaccacccatctcgtcgtccgccgattcgatccggttcttccaacccagggtgagtctccggatccgtcgccgtctggtctccgtgtgctctcatcgccgtcgccgccgtctgactgaccccctcgcctcccgcggcgtcgggtctctggtgctgctgctgctgctgcgtgcagggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctggtgagtcgctcccaccttcccgcccgtctgtcatatcatagtcaatactgccagccgcgcgatggcctagtcacggtgccatgatttggaggcaatttgaatctaagccactgttatgacccgatactgttatgccgatgatatgacagtagtccttagcggctctttctagatgcgaaggcgacctggttttagttttagatctatagtttatactggtttgcacggctgcatctcgtttactgctactgatacagctcagtgagatgaatgagcatgcaaaacgtctagccattttgctggtagttgacattgcaatgacttgttagcggcgttctataattttgtgcctagtcaatattcttcttgcaaccttgccaacagtccagaccagcagctccactaatactatgccttatatgtatatttaaggatcagcatgattcaacatggattctggcgccatcattctgaccacctattaactataaagtttgcctgtctatatatttaaccttttaggataacaattaacatgatggaggttgacctttaggattgtatacatcgcaaaaataagcgtttttttggtactggggaagtacaggggtggtatttgtcttcgctgttgccaagttcttttttcattggttggtggctgaatgctggtttgaaccaaaatgttacctttggcttctatacaagttaatattagttggaagttggaacaaacctggctacaaggacattcagttcaggctatcattatcatttccaagtcagatcctatcgtctgctgcaactaatgtttcattttgtttgacagtatgaaaataatactagcgtttttttccatgatatgaaatgattttatatctagaacctgatagctgatgctcttaaacagcatatttgtgagagattttgtgccccttggcaatcggcaattcgcaccacgataatttatagccaagtgtactgtttttggaaatattcaaactgatttctgtggttgcttaacctgtatgtgcttgtgctttgtgaatcaatctttttggttactaatagtaacaagtcaaccttttttgggttgagtgtagcaacaataattttttgtcttttatttttgtaataatgcaatttgttgatgccattttcagggtcgtccaaaaggtgtcaccccaaagtacagcttgaagcctcttgttccacgcttgtctgagctccttggagttgaagtatgctaagatttgacattagcttattttagtacctgctatctttcagttattctaagtgctaatatgtgtgcataaataggtcgtgatggccaatgattgcattggtgaggaagtcgagaagttggctgccgctttgccagaaggtggagttctgctcctagagaatgttagattctacaaggaggaagagaagaacgaacctgagtttgctaagaagcttgcatctgttgctgacctttatgtcaatgatgcttttggcacggcacacagagctcatgcttcaaccgaaggagttaccaagtatttgaagcctgctgttgctggcttcctcatgcagaaggtaataaaatgtcacccatgctcatgatcttttaagtatatttaggtactgttcagtaggatggggtaaatattttctacctttcaaaagagaccaataaatctttttaacatttcagttttttcataaataaaaaaggaaagatttgacaaatgactttattatctcaggaacttgactaccttgttggagctgttgccaacccaaagaagccatttgccgccattgttggtggatccaaggtctcaactaagattggtgtcattgagtcgttgctggcgaaggtcgatatcctcatccttggtggtggtatgatctacacattttacaaggcacagggatattctgttggaaaatctctcgtggaagaggataaactcgagctcgcaacttctcttattgagaaggcgaaggcaaagggggtttctcttttgcttcccactgatattgtagtagcggacaagtttgcagccgatgctgagagcaaggtttgtttatttacacataaacacctcagatggcacttcagaattatttctttctttccctttaatgaatcgtgaaagctattcactagtaattctgccgcataa

SEQ ID NO: 343 - DNA, 3613 bp, Zea Mays
ccgtccgatccctgctactccgcagcgctaaaagctgcagctgcaggtcagcaaccagttggagccaaaacaatggtcgaggccgccggagcggaggccacgagacgagaccggggacgatcgatagcaggccacctccatctggccgttgcctttccaacacatcggtttcccttccagaaccttcccaccctcccattccaaaaccatcgaatccgcgccgtccattaccaatccgcgggcccaggaaacccgcaggcgccgctcttacccccttcccaagccacaccgttcccccgccgccaccaggtcccaccaagcgcggcccccgcgtgtcaggcgcacaaacagccacacaccgcccgtgtggctgcgtccggctgtctgtctataaagaaaaacagaccgtccattcgatcgcctcacccgaagcacatcccgtcgcatcccatcccactaccacccatctcgtcgtccgccgattcgatccggttcttccaacccagggtgagtctccggatccgtcgccgtctggtctccgtgtgctctcatcgccgtcgccgccgtctgactgaccccctcgcctcccgcggcgtcgggtctctggtgctgctgctgctgctgcgtgcagggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctggtgagtcgctcccaccttcccgcccgtctgtcatatcatagtcaatactgccagccgcgcgatggcctagtcacggtgccatgatttggaggcaatttgaatctaagccactgttatgacccgatactgttatgccgatgatatgacagtagtccttagcggctctttctagatgcgaaggcgacctggttttagttttagatctatagtttatactggtttgcacggctgcatctcgtttactgctactgatacagctcagtgagatgaatgagcatgcaaaacgtctagccattttgctggtagttgacattgcaatgacttgttagcggcgttctataattttgtgcctagtcaatattcttcttgcaaccttgccaacagtccagaccagcagctccactaatactatgccttatatgtatatttaaggatcagcatgattcaacatggattctggcgccatcattctgaccacctattaactataaagtttgcctgtctatatatttaaccttttaggataacaattaacatgatggaggttgacctttaggattgtatacatcgcaaaaataagcgtttttttggtactggggaagtacaggggtggtatttgtcttcgctgttgccaagttcttttttcattggttggtggctgaatgctggtttgaaccaaaatgttacctttggcttctatacaagttaatattagttggaagttggaacaaacctggctacaaggacattcagttcaggctatcattatcatttccaagtcagatcctatcgtctgctgcaactaatgtttcattttgtttgacagtatgaaaataatactagcgtttttttccatgatatgaaatgattttatatctagaacctgatagctgatgctcttaaacagcatatttgtgagagattttgtgccccttggcaatcggcaattcgcaccacgataatttatagccaagtgtactgtttttggaaatattcaaactgatttctgtggttgcttaacctgtatgtgcttgtgctttgtgaatcaatctttttggttactaatagtaacaagtcaaccttttttgggttgagtgtagcaacaataattttttgtcttttatttttgtaataatgcaatttgttgatgccattttcagggtcgtccaaaaggtgtcaccccaaagtacagcttgaagcctcttgttccacgcttgtctgagctccttggagttgaagtatgctaagatttgacattagcttattttagtacctgctatctttcagttattctaagtgctaatatgtgtgcataaataggtcgtgatggccaatgattgcattggtgaggaagtcgagaagttggctgccgctttgccagaaggtggagttctgctcctagagaatgttagattctacaaggaggaagagaagaacgaacctgagtttgctaagaagcttgcatctgttgctgacctttatgtcaatgatgcttttggcacggcacacagagctcatgcttcaaccgaaggagttaccaagtatttgaagcctgctgttgctggcttcctcatgcagaaggtaataaaatgtcacccatgctcatgatcttttaagtatatttaggtactgttcagtaggatggggtaaatattttctacctttcaaaagagaccaataaatctttttaacatttcagttttttcataaataaaaaaggaaagatttgacaaatgactttattatctcaggaacttgactaccttgttggagctgttgccaacccaaagaagccatttgccgccattgttggtggatccaaggtctcaactaagattggtgtcattgagtcgttgctggcgaaggtcgatatcctcatccttggtggtggtatgatctacacattttacaaggcacagggatattctgttggaaaatctctcgtggaagaggataaactcgagctcgcaacttctcttattgagaaggcgaaggcaaagggggtttctcttttgcttcccactgatattgtagtagcggacaagtttgcagccgatgctgagagcaaggtttgtttatttacacataaacacctcagatggcacttcagaattatttctttctttccctttaatgaatcgtgaaagctattcactagtaattctgccgcataagtcgtgcagcagagtagaattagacatgaatagttcagtgttaatagtgatatgacatgttattttgtacgatagtttttccacagtgcagcaccggaaacaaatttgccatgctaacttgagtgacttctacagattgtccctgccactgctatccctgatgactggatgggtcttgatgttggccctgatgccaccaaaacattcgacgaagcattggacaccaccaagactgttatttggaacggccccatgggagtgtttgagttccagaagtttgcagctggcaccgaggttaatataacattgcatataatctgtggttgccacgcccatttttattttattggttttggtacctaaaaggacaattacgtttcttcaggcgattgccaagaagctagctgagcttacaaccacgaagggtgtcactaccatcatcggcggtggcgactctgtcgctgctgtcgagaaggctgggctggccgacaagatgagccacatttcgaccggcggcggtgcgagcttggaactcttggaaggcaagactctacctggtgtccttgccctcgatgacgcctagatccgctgctgctgctgctactc

SEQ ID NO: 344 - DNA, 3581 bp, Zea Mays
cgtccggctgtctgtctataaagaaaaacagaccgtccattcgatcgcctcacccgaagcacatcccgtcgcatcccatcccactaccacccatctcgtcgtccgccgattcgatccggttcttccaacccagggtgagtctccggatccgtcgccgtctggtctccgtgtgctctcatcgccgtcgccgccgtctgactgaccccctcgcctcccgcggcgtcgggtctctggtgctgctgctgctgctgcgtgcagggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctggtgagtcgctcccaccttcccgcccgtctgtcatatcatagtcaatactgccagccgcgcgatggcctagtcacggtgccatgatttggaggcaatttgaatctaagccactgttatgacccgatactgttatgccgatgatatgacagtagtccttagcggctctttctagatgcgaaggcgacctggttttagttttagatctatagtttatactggtttgcacggctgcatctcgtttactgctactgatacagctcagtgagatgaatgagcatgcaaaacgtctagccattttgctggtagttgacattgcaatgacttgttagcggcgttctataattttgtgcctagtcaatattcttcttgcaaccttgccaacagtccagaccagcagctccactaatactatgccttatatgtatatttaaggatcagcatgattcaacatggattctggcgccatcattctgaccacctattaactataaagtttgcctgtctatatatttaaccttttaggataacaattaacatgatggaggttgacctttaggattgtatacatcgcaaaaataagcgtttttttggtactggggaagtacaggggtggtatttgtcttcgctgttgccaagttcttttttcattggttggtggctgaatgctggtttgaaccaaaatgttacctttggcttctatacaagttaatattagttggaagttggaacaaacctggctacaaggacattcagttcaggctatcattatcatttccaagtcagatcctatcgtctgctgcaactaatgtttcattttgtttgacagtatgaaaataatactagcgtttttttccatgatatgaaatgattttatatctagaacctgatagctgatgctcttaaacagcatatttgtgagagattttgtgccccttggcaatcggcaattcgcaccacgataatttatagccaagtgtactgtttttggaaatattcaaactgatttctgtggttgcttaacctgtatgtgcttgtgctttgtgaatcaatctttttggttactaatagtaacaagtcaaccttttttgggttgagtgtagcaacaataattttttgtcttttatttttgtaataatgcaatttgttgatgccattttcagggtcgtccaaaaggtgtcaccccaaagtacagcttgaagcctcttgttccacgcttgtctgagctccttggagttgaagtatgctaagatttgacattagcttattttagtacctgctatctttcagttattctaagtgctaatatgtgtgcataaataggtcgtgatggccaatgattgcattggtgaggaagtcgagaagttggctgccgctttgccagaaggtggagttctgctcctagagaatgttagattctacaaggaggaagagaagaacgaacctgagtttgctaagaagcttgcatctgttgctgacctttatgtcaatgatgcttttggcacggcacacagagctcatgcttcaaccgaaggagttaccaagtatttgaagcctgctgttgctggcttcctcatgcagaaggtaataaaatgtcacccatgctcatgatcttttaagtatatttaggtactgttcagtaggatggggtaaatattttctacctttcaaaagagaccaataaatctttttaacatttcagttttttcataaataaaaaaggaaagatttgacaaatgactttattatctcaggaacttgactaccttgttggagctgttgccaacccaaagaagccatttgccgccattgttggtggatccaaggtctcaactaagattggtgtcattgagtcgttgctggcgaaggtcgatatcctcatccttggtggtggtatgatctacacattttacaaggcacagggatattctgttggaaaatctctcgtggaagaggataaactcgagctcgcaacttctcttattgagaaggcgaaggcaaagggggtttctcttttgcttcccactgatattgtagtagcggacaagtttgcagccgatgctgagagcaaggtttgtttatttacacataaacacctcagatggcacttcagaattatttctttctttccctttaatgaatcgtgaaagctattcactagtaattctgccgcataagtcgtgcagcagagtagaattagacatgaatagttcagtgttaatagtgatatgacatgttattttgtacgatagtttttccacagtgcagcaccggaaacaaatttgccatgctaacttgagtgacttctacagattgtccctgccactgctatccctgatgactggatgggtcttgatgttggccctgatgccaccaaaacattcgacgaagcattggacaccaccaagactgttatttggaacggccccatgggagtgtttgagttccagaagtttgcagctggcaccgaggttaatataacattgcatataatctgtggttgccacgcccatttttattttattggttttggtacctaaaaggacaattacgtttcttcaggcgattgccaagaagctagctgagcttacaaccacgaagggtgtcactaccatcatcggcggtggcgactctgtcgctgctgtcgagaaggctgggctggccgacaagatgagccacatttcgaccggcggcggtgcgagcttggaactcttggaaggcaagactctacctggtgtccttgccctcgatgacgcctagatccgctgctgctgctgctactcaggttctgccagctttgcgtgtcatcttgtttcggaccttggtgtagcactgcaaggctaaggtttactcctccacacatggactttcgaggataggcttgccaccgtgttttgctagatgagtcgtgaaataagcttttacttcctcgctgctgtgggtgaagtgactggaattcggaaatttggaactaacaaaaccccccgtggatttgtatgatacgttttgttcgacagtttgcgtcccatctttcactgtggtatctggtatggtatgttcttattttttgtctgacagagtgacagtttgcattcctgtgttgccgttgctattcgttcctgct

SEQ ID NO: 345 - DNA, 3549 bp, Zea Mays
ccgtccattcgatcgcctcacccgaagcacatcccgtcgcatcccatcccactaccacccatctcgtcgtccgccgattcgatccggttcttccaacccagggtgagtctccggatccgtcgccgtctggtctccgtgtgctctcatcgccgtcgccgccgtctgactgaccccctcgcctcccgcggcgtcgggtctctggtgctgctgctgctgctgcgtgcagggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctggtgagtcgctcccaccttcccgcccgtctgtcatatcatagtcaatactgccagccgcgcgatggcctagtcacggtgccatgatttggaggcaatttgaatctaagccactgttatgacccgatactgttatgccgatgatatgacagtagtccttagcggctctttctagatgcgaaggcgacctggttttagttttagatctatagtttatactggtttgcacggctgcatctcgtttactgctactgatacagctcagtgagatgaatgagcatgcaaaacgtctagccattttgctggtagttgacattgcaatgacttgttagcggcgttctataattttgtgcctagtcaatattcttcttgcaaccttgccaacagtccagaccagcagctccactaatactatgccttatatgtatatttaaggatcagcatgattcaacatggattctggcgccatcattctgaccacctattaactataaagtttgcctgtctatatatttaaccttttaggataacaattaacatgatggaggttgacctttaggattgtatacatcgcaaaaataagcgtttttttggtactggggaagtacaggggtggtatttgtcttcgctgttgccaagttcttttttcattggttggtggctgaatgctggtttgaaccaaaatgttacctttggcttctatacaagttaatattagttggaagttggaacaaacctggctacaaggacattcagttcaggctatcattatcatttccaagtcagatcctatcgtctgctgcaactaatgtttcattttgtttgacagtatgaaaataatactagcgtttttttccatgatatgaaatgattttatatctagaacctgatagctgatgctcttaaacagcatatttgtgagagattttgtgccccttggcaatcggcaattcgcaccacgataatttatagccaagtgtactgtttttggaaatattcaaactgatttctgtggttgcttaacctgtatgtgcttgtgctttgtgaatcaatctttttggttactaatagtaacaagtcaaccttttttgggttgagtgtagcaacaataattttttgtcttttatttttgtaataatgcaatttgttgatgccattttcagggtcgtccaaaaggtgtcaccccaaagtacagcttgaagcctcttgttccacgcttgtctgagctccttggagttgaagtatgctaagatttgacattagcttattttagtacctgctatctttcagttattctaagtgctaatatgtgtgcataaataggtcgtgatggccaatgattgcattggtgaggaagtcgagaagttggctgccgctttgccagaaggtggagttctgctcctagagaatgttagattctacaaggaggaagagaagaacgaacctgagtttgctaagaagcttgcatctgttgctgacctttatgtcaatgatgcttttggcacggcacacagagctcatgcttcaaccgaaggagttaccaagtatttgaagcctgctgttgctggcttcctcatgcagaaggtaataaaatgtcacccatgctcatgatcttttaagtatatttaggtactgttcagtaggatggggtaaatattttctacctttcaaaagagaccaataaatctttttaacatttcagttttttcataaataaaaaaggaaagatttgacaaatgactttattatctcaggaacttgactaccttgttggagctgttgccaacccaaagaagccatttgccgccattgttggtggatccaaggtctcaactaagattggtgtcattgagtcgttgctggcgaaggtcgatatcctcatccttggtggtggtatgatctacacattttacaaggcacagggatattctgttggaaaatctctcgtggaagaggataaactcgagctcgcaacttctcttattgagaaggcgaaggcaaagggggtttctcttttgcttcccactgatattgtagtagcggacaagtttgcagccgatgctgagagcaaggtttgtttatttacacataaacacctcagatggcacttcagaattatttctttctttccctttaatgaatcgtgaaagctattcactagtaattctgccgcataagtcgtgcagcagagtagaattagacatgaatagttcagtgttaatagtgatatgacatgttattttgtacgatagtttttccacagtgcagcaccggaaacaaatttgccatgctaacttgagtgacttctacagattgtccctgccactgctatccctgatgactggatgggtcttgatgttggccctgatgccaccaaaacattcgacgaagcattggacaccaccaagactgttatttggaacggccccatgggagtgtttgagttccagaagtttgcagctggcaccgaggttaatataacattgcatataatctgtggttgccacgcccatttttattttattggttttggtacctaaaaggacaattacgtttcttcaggcgattgccaagaagctagctgagcttacaaccacgaagggtgtcactaccatcatcggcggtggcgactctgtcgctgctgtcgagaaggctgggctggccgacaagatgagccacatttcgaccggcggcggtgcgagcttggaactcttggaaggcaagactctacctggtgtccttgccctcgatgacgcctagatccgctgctgctgctgctactcaggttctgccagctttgcgtgtcatcttgtttcggaccttggtgtagcactgcaaggctaaggtttactcctccacacatggactttcgaggataggcttgccaccgtgttttgctagatgagtcgtgaaataagcttttacttcctcgctgctgtgggtgaagtgactggaattcggaaatttggaactaacaaaaccccccgtggatttgtatgatacgttttgttcgacagtttgcgtcccatctttcactgtggtatctggtatggtatgttcttattttttgtctgacagagtgacagtttgcattcctgtgttgccgttgctattcgttcctgct

SEQ ID NO: 346 - DNA, 3728 bp, Zea Mays
ccgtccattcgatcgcctcacccgaagcacatcccgtcgcatcccatcccactaccacccatctcgtcgtccgccgattcgatccggttcttccaacccagggtgagtctccggatccgtcgccgtctggtctccgtgtgctctcatcgccgtcgccgccgtctgactgaccccctcgcctcccgcggcgtcgggtctctggtgctgctgctgctgctgcgtgcagggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctggtgagtcgctcccaccttcccgcccgtctgtcatatcatagtcaatactgccagccgcgcgatggcctagtcacggtgccatgatttggaggcaatttgaatctaagccactgttatgacccgatactgttatgccgatgatatgacagtagtccttagcggctctttctagatgcgaaggcgacctggttttagttttagatctatagtttatactggtttgcacggctgcatctcgtttactgctactgatacagctcagtgagatgaatgagcatgcaaaacgtctagccattttgctggtagttgacattgcaatgacttgttagcggcgttctataattttgtgcctagtcaatattcttcttgcaaccttgccaacagtccagaccagcagctccactaatactatgccttatatgtatatttaaggatcagcatgattcaacatggattctggcgccatcattctgaccacctattaactataaagtttgcctgtctatatatttaaccttttaggataacaattaacatgatggaggttgacctttaggattgtatacatcgcaaaaataagcgtttttttggtactggggaagtacaggggtggtatttgtcttcgctgttgccaagttcttttttcattggttggtggctgaatgctggtttgaaccaaaatgttacctttggcttctatacaagttaatattagttggaagttggaacaaacctggctacaaggacattcagttcaggctatcattatcatttccaagtcagatcctatcgtctgctgcaactaatgtttcattttgtttgacagtatgaaaataatactagcgtttttttccatgatatgaaatgattttatatctagaacctgatagctgatgctcttaaacagcatatttgtgagagattttgtgccccttggcaatcggcaattcgcaccacgataatttatagccaagtgtactgtttttggaaatattcaaactgatttctgtggttgcttaacctgtatgtgcttgtgctttgtgaatcaatctttttggttactaatagtaacaagtcaaccttttttgggttgagtgtagcaacaataattttttgtcttttatttttgtaataatgcaatttgttgatgccattttcagggtcgtccaaaaggtgtcaccccaaagtacagcttgaagcctcttgttccacgcttgtctgagctccttggagttgaagtatgctaagatttgacattagcttattttagtacctgctatctttcagttattctaagtgctaatatgtgtgcataaataggtcgtgatggccaatgattgcattggtgaggaagtcgagaagttggctgccgctttgccagaaggtggagttctgctcctagagaatgttagattctacaaggaggaagagaagaacgaacctgagtttgctaagaagcttgcatctgttgctgacctttatgtcaatgatgcttttggcacggcacacagagctcatgcttcaaccgaaggagttaccaagtatttgaagcctgctgttgctggcttcctcatgcagaaggtaataaaatgtcacccatgctcatgatcttttaagtatatttaggtactgttcagtaggatggggtaaatattttctacctttcaaaagagaccaataaatctttttaacatttcagttttttcataaataaaaaaggaaagatttgacaaatgactttattatctcaggaacttgactaccttgttggagctgttgccaacccaaagaagccatttgccgccattgttggtggatccaaggtctcaactaagattggtgtcattgagtcgttgctggcgaaggtcgatatcctcatccttggtggtggtatgatctacacattttacaaggcacagggatattctgttggaaaatctctcgtggaagaggataaactcgagctcgcaacttctcttattgagaaggcgaaggcaaagggggtttctcttttgcttcccactgatattgtagtagcggacaagtttgcagccgatgctgagagcaaggtttgtttatttacacataaacacctcagatggcacttcagaattatttctttctttccctttaatgaatcgtgaaagctattcactagtaattctgccgcataagtcgtgcagcagagtagaattagacatgaatagttcagtgttaatagtgatatgacatgttattttgtacgatagtttttccacagtgcagcaccggaaacaaatttgccatgctaacttgagtgacttctacagattgtccctgccactgctatccctgatgactggatgggtcttgatgttggccctgatgccaccaaaacattcgacgaagcattggacaccaccaagactgttatttggaacggccccatgggagtgtttgagttccagaagtttgcagctggcaccgaggttaatataacattgcatataatctgtggttgccacgcccatttttattttattggttttggtacctaaaaggacaattacgtttcttcaggcgattgccaagaagctagctgagcttacaaccacgaagggtgtcactaccatcatcggcggtggcgactctgtcgctgctgtcgagaaggctgggctggccgacaagatgagccacatttcgaccggcggcggtgcgagcttggaactcttggaaggcaagactctacctggtgtccttgccctcgatgacgcctagatccgctgctgctgctgctactcaggttctgccagctttgcgtgtcatcttgtttcggaccttggtgtagcactgcaaggctaaggtttactcctccacacatggactttcgaggataggcttgccaccgtgttttgctagatgagtcgtgaaataagcttttacttcctcgctgctgtgggtgaagtgactggaattcggaaatttggaactaacaaaaccccccgtggatttgtatgatacgttttgttcgacagtttgcgtcccatctttcactgtggtatctggtatggtatgttcttattttttgtctgacagagtgacagtttgcattcctgtgttgccgttgctattcgttcctgctacctgtggcgccagatgaattgggaacaaggttttctagtttagttggttaaattatcttctttcagtgttgttctggagtggtggtagctaatggcggcccttgcaaataaaaacttgctacccgagtttggcgctggcgcagcaatttattcattcattttatggcccgtttggatc

SEQ ID NO: 347 - DNA, 3229 bp, Zea Mays
aaaccacagcactggatagaacacgccaaaagcaagagatatttcagtttcgctcttgtctcagctcagctcagctcctgccagtcgcaactcgcgtcctctccaaaaaaacagcccacagttgaagcgaaaacacgaaagctcagtgatatttctctccaggtctgcacactcgtctcctatcgagactgtcggcggccatcgtcgcccacgctgtgctcatgtacgtcccgattcttaggtgtttaattttgcgggtatttttgagaatttgggattcgattttacggcactgatgttcaactggacaatgaatacttcggttactagctcactgttgccttctatgaatttgctgacatgcctttctttctccaccgtctctcgccgcaggctaagtgtcgaggctcacacgtactactactacccgaccgcgaggccgagacggaagctatgcgcctgcagaaacgtcttgcaagaaaccgccccgcgtgacgcggaggcagatccctgccgccacggcgagaggaagagcaggagaaggggcgacggtgcttattacatcgacaaggacggcggcggcgtagccaggaccttcgaccggaagaaaatatccagaaagaggggtacggtaaatgattatgacagtgtgccagtgtgccacaccactccttaattttagttcccacacaatgctgcagatcaatgccagttcttagatcttcttcttttttttttaaaaaaaagcaagaacacaaaggttgttccttttccggattcactcactgttccatgcattggaagttcaaggacaacatggcgtaggtaggttctagctctgaatggcatggcatggcttgggcttgggcgtgcagggggtgctatcaaagggcgtggatggaagtacggctccgggttcgtcgacggagtgttcccagtgctgagtccgatggcgcaggatgtgctagaactcgtgcagacgagggggaccgacgccgccagcgtctgggagtcactggacaagatccctcaagcacacgatctttgggacgacatcgtcaacgtcgccgtccagctccgcctgaaccggcaatgggagccgatcatcacagtgagtctgagtcctaaccgaaccgcagccccgcacactcttgctgcctgcattgactctgaaacttgcaagagcaaaaatcctcagcctttggctatgggtgtttgatctgatctgcctataggtctgcgagtgggtcctgcgccggagctcgttccgccccgacatcatctgctacaacctgctcatcgacgcgtacggccagaagcgtcagctgagcgaggcggaggcggcctacatggcgcttctggaggctcgctgcgtgcctacggaggacacctacgctctgctgctgcgcgcgtactgcggctccgggcagctgcaccgagccgagggcgtgatttcggagatgcagaggaacgggatccctcccagtacgcaacgcaacgcatcgtgtgttcctctgtcatgagatgaagtgaaatcatgccaagaactctctctctctctcttgcattgcagctgcgactgtgtacaacgcgtacctggacggtctgctgaaagcgaggtgttcggagaaggcggttgaagtgtaccagaggatgaagaaggagcgctgcagaactaacaccgagacctacaccctgatgatcaacgtgtatgggaaagtaagccatttttttgctggattaatcttttaatgtgcagggatctgagatctgactcaaaagtgtgtgtgagtgtcatcgttctgagagagacaatggccgtcattcatgcatactcacccttctgcatgcaatgcaggcaaatcagccgatgtcgtcgttgagagtgttcagggagatgaaatcggtcgggtgcaagcccaacatctgcacctacacggcgctggtgaacgcgttcgcgcgggaaggcctgtgcgagaaggcagaggaggtgttcgaggagatgcagcaggctgggcacgaacctgacgtgtacgcctacaatgctctgatggaagcttacagccgcgcagggctgccgcaaggggcgtcggagatcttctctttgatggaacacatggggtgcgagcctgatagagcctcttacaacatactggtggatgctttcggacgagctggtcttcaccaaggtatgcacccagccacacctgccgctacatcgcatgcagtagctgcctcaagaagctagctttggctggtgagctcaagaactcgctggatttactggtgccttttttgttgttgttgttgtggctgtttgtacgttccagaggcggaagcagcgttccaagagctgaagcagcagggcatgcggccgacgatgaagtcgcacatgctgctcctgtcggcgcacgccaggtccggcaacgtggcgaggtgcgaggaggtgatggcgcagctgcacaagtccgggctgcgcccggacaccttcgcgctcaacgccatgctcaacgcgtacggccgggccgggcggctggacgacatggagcggctcttcgcggccatggagcgcggcgacggcgcgatcgccggcgccccggacaccagcacgtacaacgtgatggtgaacgcgtacgggcgcgcggggtacctggaccggatggaggcggcgttccgctccctggcggcgcggggcctcgccgccgacgtggtgacgtggacgtcccgcatcggcgcgtacgccaggaagaaggagtacgggcagtgcctgcgggtcttcgaggagatggtggacgccgggtgctacccggacgccggcaccgccaaggtgctgctcgccgcgtgctccgacgagcgccaggtggagcaggtcaaggccattgtcaggtccatgcacaaggacgccaagacgctcttcgcattgtgaaatccgcgcaggctaaattccgatcctgctgcgtgatcacatacgaaccttgacgagagtcacctagcttgcatactggttaacaagtcacaaggccccgtttggttacatatagaataatctactttttagtcccgtttagtacttaattgtatttagtctctagcccttcactgtaagggcctcacatcacatgggtgctaaaggggacgaaaggacatcatttactctaattaccattgcatagagaatatgcaccgtatacatgcaataaaaagagaggcatttcagtctgtgtacttc

SEQ ID NO: 348 - DNA, 2200 bp, Zea Mays
attcctactgttagttttgtgaattcggaggcgcagcgccaccaacttgcaccattttggcaaccccgcagggacaaaagaaaggcgaaacgaggccaccagctcaccgccgagcggaagcggcgccgagcaaccaacccctctcctcgtccgccgccgtctccccggaccatggccatggccgccgcctcctcccggctgttctgggcgtcccgcgccgccgcctacctcaggatctccaccttccccagggccttcgccaccggtacgcccgccaccccccatcctctgtctccggcgccctggttcctcggatcacggctcctcgcggttggtacggcgccaccttgtgtcgtttcgcgcgcgtatagatcccgactcgcggttggtactgttcctgatttgggccgtggttctgcgttccatcagacggcgcatgcgttcagggatggggggtttacaatggggtttagccgccgccgctccttatttatcatgaatgctttgtctttcccggcgggggggggggggggggggggggggttcgttcgttcgttcatggtggacagcgtgtgtgtggaagagaagaaacaaagatcttgtatttacagtgctaatgtgtttggaagatcgatttccccagatttatttgtgttaggtgtggacgagggaggcaatgtgttacaaactgaaattaatatttttatatgaatactcaaatatttatatatttgtgttggatcttagatggcctttggtaaacctgtgcttcagtacagtttttttgttgtggggtttgttctgcaacagtaaaatgtggctgagaaaaaaatgactggttccttgtaagagatatacatatttgttttttttggtatcaaatagactaaatggtggtctcagaaagtcactgggtggggttggtgtagtacttctgtgtgcattgttgcccccacaatgccactccaatgcatacaacctctgatgctccacatgttacccccttttttcagtgctgaaggatctgaagtatgctgacactcatgaatgggtgaaagttgagggtgattcagcaaccgtggggattactgaccatgcccaggttaacacgctcacatatttctattgctgtgagtttagagtgtgaggcaatactaggtgttagtgttaggccctccatatgtttaggttgtctggtgctgtagttcttatcaacactgatatgcatactgcatccaatctgttgccaagacatcaagttctaatatattatatcatgttcagtatacatatgttagtgaaagacagacctagtgtagtggtgagagctgtcttactgactcaccagtcgcgggtttcaagtggcctctctgcatttgtggaggaggttgcctcctccagcactaggtctcctcttttcagtatacatatgtgaggcttgcctcggtttatcacttccctagactccactcatgtgggagccctcgtcactaggtttgtccagtatataacattagggtttgcattgcttaaaatttgtttattgcttttggcgtccaggatcatttgggtgatgttgtttttgtggagctaccagaagttggcatcagtgtatcccagggaaagaactttggtgctgttgagagtgtgaaggcaaccagcgatatcaattcaccagtgtctggagaggtggttgaagtgaacgagaaactaagtgaggagcctggattggtaagtgttgcaactaatattagccagaactcatctgaaaataaaattctgtgggtagattagtcgatgattatcatttctgattaggttaatgcaagtccatatgagaagggatggattatcaaggtcaagctcagcaattcaggtgacctcaattcgctcatggatgatgataagtactcgaaattctgtgaagaagaagacaaccattgaagaaatcagagtgtcttctaaacaccaggacctgtttttcaagctttatcactggttatggtctggagaccagctgtgacaaattggcaaggttcatcgcaaggaataaatgttaggatttgccaatcctacaagggcatgggaaatccaagtttgtgttgtcaatgacgtggtcatatttgatatttctttgtagttgtaatctcgtgaattccttcttttttcttaaaaaaagtactctttttgattccttcct

SEQ ID NO: 349 - DNA, 2252 bp, Zea Mays
attcctactgttagttttgtgaattcggaggcgcagcgccaccaacttgcaccattttggcaaccccgcagggacaaaagaaaggcgaaacgaggccaccagctcaccgccgagcggaagcggcgccgagcaaccaacccctctcctcgtccgccgccgtctccccggaccatggccatggccgccgcctcctcccggctgttctgggcgtcccgcgccgccgcctacctcaggatctccaccttccccagggccttcgccaccggtacgcccgccaccccccatcctctgtctccggcgccctggttcctcggatcacggctcctcgcggttggtacggcgccaccttgtgtcgtttcgcgcgcgtatagatcccgactcgcggttggtactgttcctgatttgggccgtggttctgcgttccatcagacggcgcatgcgttcagggatggggggtttacaatggggtttagccgccgccgctccttatttatcatgaatgctttgtctttcccggcgggggggggggggggggggggggggttcgttcgttcgttcatggtggacagcgtgtgtgtggaagagaagaaacaaagatcttgtatttacagtgctaatgtgtttggaagatcgatttccccagatttatttgtgttaggtgtggacgagggaggcaatgtgttacaaactgaaattaatatttttatatgaatactcaaatatttatatatttgtgttggatcttagatggcctttggtaaacctgtgcttcagtacagtttttttgttgtggggtttgttctgcaacagtaaaatgtggctgagaaaaaaatgactggttccttgtaagagatatacatatttgttttttttggtatcaaatagactaaatggtggtctcagaaagtcactgggtggggttggtgtagtacttctgtgtgcattgttgcccccacaatgccactccaatgcatacaacctctgatgctccacatgttacccccttttttcagtgctgaaggatctgaagtatgctgacactcatgaatgggtgaaagttgagggtgattcagcaaccgtggggattactgaccatgcccaggttaacacgctcacatatttctattgctgtgagtttagagtgtgaggcaatactaggtgttagtgttaggccctccatatgtttaggttgtctggtgctgtagttcttatcaacactgatatgcatactgcatccaatctgttgccaagacatcaagttctaatatattatatcatgttcagtatacatatgttagtgaaagacagacctagtgtagtggtgagagctgtcttactgactcaccagtcgcgggtttcaagtggcctctctgcatttgtggaggaggttgcctcctccagcactaggtctcctcttttcagtatacatatgtgaggcttgcctcggtttatcacttccctagactccactcatgtgggagccctcgtcactaggtttgtccagtatataacattagggtttgcattgcttaaaatttgtttattgcttttggcgtccaggatcatttgggtgatgttgtttttgtggagctaccagaagttggcatcagtgtatcccagggaaagaactttggtgctgttgagagtgtgaaggcaaccagcgatatcaattcaccagtgtctggagaggtggttgaagtgaacgagaaactaagtgaggagcctggattggtaagtgttgcaactaatattagccagaactcatctgaaaataaaattctgtgggtagattagtcgatgattatcatttctgattaggttaatgcaagtccatatgagaagggatggattatcaaggtcaagctcagcaattcaggtgacctcaattcgctcatggatgatgataagtactcgaaattctgtgaagaagaagacaaccattgaagaaatcagagtgtcttctaaacaccaggacctgtttttcaagctttatcactggttatggtctggagaccagctgtgacaaattggcaaggttcatcgcaaggaataaatgttaggatttgccaatcctacaagggcatgggaaatccaagtttgtgttgtcaatgacgtggtcatatttgatatttctttgtagttgtaatctcgtgaattccttcttttttcttaaaaaaagtactctttttgattccttcctatgcaaatttcttggtgctttcgcgaatggttcagattcttcagcattgtta

SEQ ID NO: 350 - DNA, 5419 bp, Zea Mays
aacacgaggctcccggactcctcagttccttcgctcctctgtaacccggggcggccgacgaggccgggaccaccgacggcgacgatgggcggcggcgagggcaagtccaagaaacgccgctcttctacctcctcaggtacccagccacccagggatacctatcgtatcccctatttggttgaatccgtcggttcgttttgctgcggaccatcgatttctttcttccttggtttagcggatgaagaagggggggaacggaagaggcgggacaagaaggagagcaagaggaggagccgagacgacagggaggatgacgatgacagacacaagaagaaggggaaacacatcgacaggaacaaaggaaaaggttgggttcctaaatcgttacagcttccggttctttgatttcgtcaacattccaaggatgttatgtcacaaaaacattccaagaatgctaaatcgttacagcttcggttatcattttctgaaaaaaaagcgcttatttctgtgttttcgaggctcagcgtgttaagtgaatttctgctcgctccatgtacactatggttatgtgaaataaagctttgataggttgtgactttgatgtgtgtttctgtgttgatagagagagattcgaaggataggcattccaaggagaagacgagcaagagaaaagacaaggacgctgtaagttctttaacgagtgacgttatattcagactcagttttgttgggcagtgccaagtaaatagttaacattggcatattcggttcctttgaattactgatatttggtacctctttagggctacgttttttgacttggataaattgttgcggaacattatgcttgtcatgggtctataatggaatggtgctctgaaatagaaaatgtaggagtgttggtgttatgtacggccaggcctatactaggcgctacagggccttaggatagggcccaaggcccatagttcatacttatccatacttatctagatagcttagttcatacttatctagatagctagcttccatataaatacttgtaagacaccttgagattgtcaagcagaaacaagattgtttccggcttcctttagggagtcgggattcctccagttctagccctagccgctacctctagccctagctggccgcccctgtgggctacgccgtcaattacggcgccggctcggcgttcgttgcacttcaagccttgtcccccaatctcccaccgctataacctacgatcagtcaggctagaggatttggtacataacaatctggtatcagagacctcgacgatcatgagcacgtccgccccctccaagccgccatcgccggtgcagcagccgccgccgtcgtcgggccagtctgcagcgctgcccgctaccctggccgcaacccccatatcgtcgggcgccatggtgctcgtcccgcccggcgcgcccgcggccgcgatcccactggcgctcaccccagcccagatcgcggcgtcgctgacagacctcagccacgccatgcgcgacgtgcatctcaccctcaacgccatgctgataggtcagctcgcataccccgcccagcatgccgcccatccaccacagccgccgctaccacccctacctgcgccgccaccccctgcacctctgccaccccccacacaaccacctgcgccgccgcccccaatatcttggcaaccaatttcctatccatacgacatgccaatcgacccaagctcatcgtccatcgcaccaccacatgccttcacccccatccagcagatccgatttccgccgtcaccttccccaatcccatcgtgggcgcagggcacgacgaggacatggctggcatcgtaccatctctagggaccggcacaaacatggtactatgccctggagcaggatgagggcatgcctccttgggaccgcttcgccgagctatgtcgtcttcgcttcgggccagcagtgcgcggttctcgccttgtgagcttggatggctacccttcctgtccacggtccaggaatacgcagaccgcttccaggcgctgctatgtcaagcacgggacatctcccctcttcagaagacggagctgttcgttggcggcctcctcgagcacctacgggtggacgtcgagctgcgcgccccgcaggatatgcagacggccatgtacctaacacgagcattcgagcggcgcgcagcggccgtgcctccatctcagccgcgcggggcacggctaccacaacggtagcaggcgaccagccgcgcgacaccagcaccacccactatcccgtcagctggtgcgacgaccgtcggcgacggcaataccccagcacgcccttttcgccgcttgtccccggtcgagcaacaggagcggcgccggcaggggctttgcttcaactgcgatgagccctatgtccgggggcacgtgtgccagcggttgttttacctggaggtagacgacttcctcgaggacgcgaccgacgagggtgcgggggatcccttggatgagccgatcgtacctgatgctgctggagccaacgcattggtggtctcgctgcacgcgctagcgggaatccgtacgaacaagacactgctactgcctatcctcataaaaggggagcgactgttggcactcatggacacggggtctactcacaacttcctcaacggggacacgatgcgtcgtctcgggcttcctatggagggtggcgagcgcctccgggtcactgtcgccaatggggactgactgccatgtgcaagaatagcccgcgacgttcccatcgtcatcggctccgagtcgttctccatcacgtgcgttgggatgcacctcggctgtttcgacttcatcctcggcgtggacttcttggagacgttggggaccatccagtggaatttccgggcgctaaccctgtcattccgacatcagggctagcgcatccactggcagggcgtgcgggcctcgcagcagcctgccccgcagcagctggctgtggcagtctccgacgctgcccaatagcccctcatggacgtcctccttcagcaacacggcgccatcttcgacgagcccacgggactgcctccggctcgctcctacgaccaccgtatacacctgctgcccggtaccgctccggtggcagtacggccgtattggtatgcacagctacagaaggacgagctggagcggcagtgtgaggccatgctagctcaaggcatcatacgatccagtacgtcgccgttctccgctccggtgctgctggtccacaaggcggacggctcgtggcgtttctgcatcgagtaccgcgccctcaatgcccagacgtccaaggacaagttctcgattccggtggtggacgagctccatggagcccgtttcttctccaagctggacttacgctcgggctaccacctggtgcgggtgcacaccgatgacatcgccaagacgacatttcgcacccaccatggccactatgagttcctggtcatgccattcggactctcgaacgcacctgccaccttccaggctttgatgaacgacgtactccgcccataccttcggaggtttgtgctggttttcttcgacgatattctgatttacagcacatcgtgggcggagcacctccagcatgtcaacatcgtcctcgagtcactgcgagcgcaccaccttcatttaaagcgctccaagtgctccttcggcgccacatcggtggcctaccttggccacatcatctcggagggcggggtcgccatagacgcgaacaaggtcgcgacggtggcctcctggccgctcccgcggtctgcacgaggacttcggggcttcttggggctggcggggtactaccgcaagttcatcaaagacttcggcctcatcgtagccccgctggcgcgtctcttgcggcgggacgcgttcgcctaggacgacgacgcgcaagcagccttcaacgccctcaagcatgccttgacgacagggccggtgctccagatgccggacttctccaagctcttcgtcgtcgattgtgacgcgtcgggtgcgggggccttaggataggcccaaggctaatagttcatgcttatccatacttatctagatagcatagttcatacttatctagatagctagcttccttataaatacttgtaagacaccttgggattgtcaagcagaaacaagattgtttccggcttcctccagttccagccctagccgccacctctagccctagccggccgcccctgtggggtgcgccgtcaactacggcgccggctcggcgttcgtcgcgcttcaagcctcgtcccccaatctcccaccgctataacctacgatcagtcaggctagaggatttggtacataacagttggcttgccttgcaagttcaagtgtataaccaaatttggcacctatttcttatttttgagcatcttgaaagaatgaatcaaggataacatgtcgcaaatttctccaattggcatagccatagtatggtcctttatgctggtgtcaatggaaacttgctagaatctatttctcatctggtggctgagtaggagatcaaaacttgacagaatttgttctcttatgaaggctgaattgacaacatagaagtgattgaaatattagtaatttagtatgcaaatgcctgaaagaaatcaataaggatggtgtgcgtacatagcttataattctagttctatgacctatatcattttttgatcatgggagttttagaaaagcggccatgtggtatttttctacaattatcaattaatataatagaagtaacaggttgttaagaataacagaaatagctgtttgactggaccaaatgttctgtatattgttccaagagacagtagtgactggcatttactgaattcggtgtcttttcttcattgccaagccttcaattatttgtttctcattcttgccaccttctgaaacaggccttcaaagaaatatccaaggatgactactttgcaaagaacaacgagttcgctacctggttgaaggaggaaaagggcaaatatttctcagatttgtcttcagagtctgctcgtgatcttttcttgaagtttgtgaaacaatggaacaaaggcaagctgccatcacaatactatgaggggattacgagtggcccacgatcagcgcacaattggaacatcaaagcatgatacgttttctggttaatcgggtccttcggcttgagatgttttttgctttcctggcgagatttttctaatagttgcatctagcaactgcttttaatattctgggttgttgtatttaagctgatgttcagaatgtctgtctaagcaggagggtagatcgtgggtctctctagtatccagtgtttaacatcaacgctacttttccattgatcactactgtttgatcctacaatgagcaaacatattgtttctaaggaaa

SEQ ID NO: 351 - protein, 206 aa, Zea Mays
MRRGSEAAVLDRHRCAQNLDAMAAGRTGVPCCRTRGKGGRRRAAAVEGMVLSLAGRACAHCPDAGLEQRGKEEGVVGERRKTTWGRLQGGRLVEREEQGRAQGAPGLGVHGGRRMKTTGKNCSQGETPTGKMEARASSAASVRGRKSRGAMDDGEEDVAGEWELLLHAMDMEFGGPGKNGAHAWAGERLLQGSSAMEQKGRCCPAR

SEQ ID NO: 352 - protein, 161 aa, Zea Mays
MYLINCKFKVIWCVVIGPSQIPGMVMDFASTSDPWRTVSLDLMQAGEEYDMQRGAHGHFYLHAFFPCMTCTVDFSLPTTTGHSSELVAGQEMDHVGVGGHGQATVMRPVEQGSGPRQFFHGRAARGRSPPVGAGVAARRPGRAVAMVGRWCSWHGSVASRQ

SEQ ID NO: 353 - protein, 92 aa, Zea Mays
MLFPLSFSIAAMPRCRAMSTTDPPWPLHALAGERPRPLRPVGSFPLQLVHGRTVGGRYPAPLAASPSPGHGRRHRRGPSPGQQLTRLNAPWW

SEQ ID NO: 354 - protein, 762 aa, Zea Mays
MWRLTVAEGGGPWLRSTNGFVGRAVWEFDPDLGTPEERDEVERVRQEFSDHRFQRRESADLLMRMQCAKQNRSQRRDLPRIKLGEDEHVTEEIVLSSLRSALDQFSSLQASDGHWPGDFSGIMFIMPGLIFALYVTGSLNVVISPEHRHEICRYIYNHQNEDGGWGTLILGSSTMFGTCSNYITLRLLGEEPYANNSVLAKGRAWILSHGGATLIPQWGKIWLSVLGLFDWSGNNPIFPELWSIPQFLPFHPGKFWCFARMVYLPMAYLYGKKFVGPITPTILALREEIYDTPYGKIDWSDARSKCAKEDLICPRTLLQNVIWTSLYRCVEPVLSSWPINKLRERALGNIMEHIHYEDENTQYLCICPVNKALNMVCCWVEDPNSDAFKRHLARIPDFLWISEDGMKAQVYDGCQSWETSFIIQAFCATDLVNDYGSTLQRAYEFMKNSQVMRNHPGDQRYWHRHRSKGSWTLSSADNGWAVSDTTGEALKAVLLLSKISNKNNLVGDPIERERLHDAIDCLLSFANKDGTFSTYECKRTYSWLEILSPCETFPNIVVDYPYPECTSSVLQALILFKDLYPGYRTEEIEALVRSAATFIETKQQEDGSWLGNWGICFTYGAFFSIKGLVASGRTYKNSPCIRKACHFILSKQLSTGGWGESHIAIETQVYVNLKGDRAHAVNTAWAMLALIYAGQFERDPTPLHRAAKELINMQLETGEFPQQEHVGCFNCSLYFNYPSYRNLFPIWALGEYHRGLRAKKDN

SEQ ID NO: 355 - protein, 153 aa, Zea Mays
MASPPPVATAGPHSVFVYGTLMEEEVVRVLLGRAPPSSSPALLPDHRRFSLRGRVYPAILPARAHAVSGKVIQGLTDRELHVFDMFEDEEYVKTTVEVSLTDASEKSLAYAYIWGNQGDPDLYGEWDFEEWRKVHLKYYLEMTREFMLELGQF

SEQ ID NO: 356 - protein, 1147 aa, Zea Mays
MKQSPASSGVTAAPVVPAPAPAAASTGAAPPCEGERKAPAINADLWYACAGPLVSLPPVGSLVVYFPQGHSEQVAASMQKDIDAHVPSYPNLPSKLICLLHSVTLHADPDTDEVYAQMTLQPVNTYGKEALQLSELALKHARPQMEFFCKTLTASDTSTHGGFSVPRRAAEKILPPLDFGMQPPAQELQARDIHDNVWTFRHIFRGQPKRHLLTTGWSLFVGGKRLFAGDSVIFVRDERQQLLLGIRRASRQPTNISSSVLSSDSMHIGVLAAAAHAAANNSPFTIFYNPRASPTEFVIPFAKFQKALYSNQISLGMRFRMMFETEELGMRRYMGTITGITDLDPVRWKNSQWRNLQVGWDESAAGERRNRVSMWEIEPIAAPFFICPQPFFGVKRPRQIDDESSEMENLFKRAMPWLGEEICIKDAQTHNTTMPGLSLVQWMNMNRPQSSTLNTGIQSEYLRSLSNPAMQNLGAAELARQLYVQNHLLQQNSVQLNASKLPQQVQPINELAKGSLSCNQLDVIINQQELKQEVGNQQRQQQPVNQAIPLSQAQTNLVQAQVIIQNQMQQQQQQQQQSPTRCQKGTSVQQLLLSQQQQDQNFQLQQQQQLLLQQLQQQNQQQQQQQQNQQQLNKLPAQLVNLAGQQAQLSDQELQLQLLQKLQQQSLVSQPTVTLSPLQVIQEQQKLLLDMQQLSSSHSLAQQRILPQQDSDVSLQASQAPPPMKQEQQKPSQKQFVLADVSDVVYPQISSTNVLSKAGTQLMTPGATQSVLTEEIPSCSTSPSTATGNHLAYPIIGRNEHCKVTIEKVPQSSSLMSIPTAGEAVTTPIMAKELSKLNHNLKENVTTSKSPIVGTGHENLLNIVPSTDNLETASSATSLWPTQTDGLLHQGFPTNFNQQQMFKDALPDVEIQEVDPTNNAFFGINSDGPLGFPMETEGLLVSAINPVKCQPNLSTDVEINYRIQKDAQQEISTSMVSQSFGQSDIAFNSIDSAINDGVMLNRNSCPPAPPQRMRTFTKVYKRGAVGRSIDIGRFSGYEELKHAVARMFGIEGQLEDRQRIGWKLVYTDHEDDVLLLGDDPWEEFVNCVKCIRILSPQEVQQMSLDGDLGNNVLSNQACSSSDGGNAWKPRRDQNPGNPSIGFYDQFE

SEQ ID NO: 357 - protein, 121 aa, Zea Mays
MVTVVAIPSKTAGHVGDRRHGCSLSGRGIDASKVLMKGLGRTLHVVVASSALLSTRALSIGHQPWPPPRAVQAPPQLRLVGSGDMMAVDWPTCGQDGGTIHPFARVNSGRWIGCRWTGLDQ

SEQ ID NO: 358 - protein, 593 aa, Zea Mays
MAAPAARRIVGAEVPIPGSDKLRWIDLTIPSSSAAAPASPSDPFVCVPPRAASGCHIIPSGDSQYYLSWRIHEEHPNVLEVIELSPSKEFPSFGLRLAFQEALSPFAFLCEREGRRQGELVYMLYVLTVSGVALLCHLRSPFSYVSGSVLHQDDIAEFNLQTQAQSAKVTAVTAKPGCIVIGRQDGSICSYSLGKLAPNSPGFSNELRDDAGIGRLWTLMSRTKTVGPVQDIVATVVNERDLLFVLHLDGHLRIWDNHMKLLNYNVHSNDIEGHPSRLWVGKADDDQELISLAILHQNTVVQGCDYVAVYGFGFSAAERFMFSSEPSISTIPLLEGKLADLKIATYKLWILKEFGSMLYEILQYDIDTETAKCCSEKVCCYVLQEDAISEQLFQSSDNALDDLVWTADSMFSSLKEQAFTLISSMFLRRLLQPGVNHCSALRETLLEHKRFLSDSEFQSLTANGLRKEILSIIEQEGSSQTASATAYHWKQFSARYLHNWCWHNKPYGLFLDTTNEVFGLVRKGSFSLFRCLEGLEMLIYGYDHGVNLLDDVSDFELLNEVLRCMGNIHHLLGRSSTAAYYESLISSIISSDE

SEQ ID NO: 359 - protein, 380 aa, Zea Mays
MYRYFVRLNREGNAGGSHQLPHVLQERLHALSAAINALQLVDPSFAWLDSICEADDKISPSKRPRNLLMENSAFGTNSELSRLQFCVDIEILEKEYILTEAQYMLSTLKSSFDFSESQSIESLMDILINEKLYDIAFTIVLKFWKESEIKKQLDRVFSVIAQQCCSNRSDNKSSKQVPLLPSSENDAWEINNRSIAVTQQLQGSNHWETLELYLDKYKDLHPRLPVIVAETLLYTDPEIELPLWLVQMFKANKAGNKISWGMSGKEADPAALFRLYINYGRHAEATNLLVEYLESFASSRPVDVLHRKKMSAVWFPYTAVERLWCQLGEMQRAGHSVDQCDRLKKLLHGALMSHLQQVVVDSDDVLSSVGDGQGMEDQSS

SEQ ID NO: 360 - protein, 655 aa, Zea Mays
MPLLANSLLSIIQTLLDQSRQDDMCIIGCETLFDFIVTQVDGTYQFNLEEFIPRLCKLSQIVRDKEKANALRAAALQSLSAMIWFMGELSHISSEFDSVVQVVLESYEPRQVQSDNSATENPGCQLVEEVLKPEGHASPSTFIFSVIPSWDSIVSDYGGIQLLMDDAKDPYFWSRVCVHNMAKLSREATTFRRVMESLFCHFDNTNSWSSKNGLALCVLLDMQMFMEKSGTNINLMISVLVKHLEHKAILKQPEMQLSIVEVITALAEQSRAQASAATIVAISDLVRHMKKTLHLALGSNDLEVVKWNDKLRMAFDECIVQLSKKVGDAGPVLDMMSVMLENISHTPLIAIATTSAVYRTAQIIASIPNLSYKNKVFPEALFHQLLLAMVHPDHETRVGAHRIFSVVLVPSSVSPFPNLKSLDQCRKHDVQRTLSRVVSVFSSSAALFDKLRRDRNSFREYLHEGSMNRILHGIDDEIATPNDLPGSQSLRQSLRLSSVSHKHSYTSLKEGQSPLTESINEMETIVLRLSSQQATLLLSSIWRQALSPKNAPQNYEAIAHTYSLLLLFLGSKTPIFEVLAPSFQIAFSLMSHSLGGTDSLPPSRRRSLFTLATSMIVFASRAFNVAPLLPICKLMLNDGTVRPIVFLSIISFFVL

SEQ ID NO: 361 - protein, 991 aa, Zea Mays
MGLDGTVSGVVSRKVLPACGGLCCLCPSLRPRSRQPVKRYKKILIDIFPAEQEDGPNVRRIGRLCEYVARNPHRVPKITAYLERRCYRELRNEQYDIVKVVVLIYRRLLVSCNEQMPLLANSLLSIIQTLLDQSRQDDMCIIGCETLFDFIVTQVDGTYQFNLEEFIPRLCKLSQIVRDKEKANALRAAALQSLSAMIWFMGELSHISSEFDSVVQVVLESYEPRQVQSDNSATENPGCQLVEEVLKPEGHASPSTFIFSVIPSWDSIVSDYGGIQLLMDDAKDPYFWSRVCVHNMAKLSREATTFRRVMESLFCHFDNTNSWSSKNGLALCVLLDMQMFMEKSGTNINLMISVLVKHLEHKAILKQPEMQLSIVEVITALAEQSRAQASAATIVAISDLVRHMKKTLHLALGSNDLEVVKWNDKLRMAFDECIVQLSKKVGDAGPVLDMMSVMLENISHTPLIAIATTSAVYRTAQIIASIPNLSYKNKVFPEALFHQLLLAMVHPDHETRVGAHRIFSVVLVPSSVSPFPNLKSLDQCRKHDVQRTLSRVVSVFSSSAALFDKLRRDRNSFREYLHEGSMNRILHGIDDEIATPNDLPGSQSLRQSLRLSSVSHKHSYTSLKEGQSPLTESINEMETIVLRLSSQQATLLLSSIWRQALSPKNAPQNYEAIAHTYSLLLLFLGSKTPIFEVLAPSFQIAFSLMSHSLGGTDSLPPSRRRSLFTLATSMIVFASRAFNVAPLLPICKLMLNDGTMDPFLHLVHENKLQAVKDYTEDPSTSYGSPEDNQNALKSLSVVELTNSCSRESMILTIMNSIRDLPDLELENIRSQLLRDFSPDDVCPSSAHFLESPGKIAPPCSDDDTDYDYQEAELIDLRNDNNTYLEASATTLAAIAIPVPTTNLLSIDELLETVVNDVSSQTGGQCLVSMAGDIPFQEMTSHCEAFSMGKHHKMSLLMSFKQNKQAAMVVVPDNQVSHAEAAHTSDKQVHGP

SEQ ID NO: 362 - protein, 915 aa, Zea Mays
MPLLANSLLSIIQTLLDQSRQDDMCIIGCETLFDFIVTQVDGTYQFNLEEFIPRLCKLSQIVRDKEKANALRAAALQSLSAMIWFMGELSHISSEFDSVVQVVLESYEPRQVQSDNSATENPGCQLVEEVLKPEGHASPSTFIFSVIPSWDSIVSDYGGIQLLMDDAKDPYFWSRVCVHNMAKLSREATTFRRVMESLFCHFDNTNSWSSKNGLALCVLLDMQMFMEKSGTNINLMISVLVKHLEHKAILKQPEMQLSIVEVITALAEQSRAQASAATIVAISDLVRHMKKTLHLALGSNDLEVVKWNDKLRMAFDECIVQLSKKVGDAGPVLDMMSVMLENISHTPLIAIATTSAVYRTAQIIASIPNLSYKNKVFPEALFHQLLLAMVHPDHETRVGAHRIFSVVLVPSSVSPFPNLKSLDQCRKHDVQRTLSRVVSVFSSSAALFDKLRRDRNSFREYLHEGSMNRILHGIDDEIATPNDLPGSQSLRQSLRLSSVSHKHSYTSLKEGQSPLTESINEMETIVLRLSSQQATLLLSSIWRQALSPKNAPQNYEAIAHTYSLLLLFLGSKTPIFEVLAPSFQIAFSLMSHSLGGTDSLPPSRRRSLFTLATSMIVFASRAFNVAPLLPICKLMLNDGTMDPFLHLVHENKLQAVKDYTEDPSTSYGSPEDNQNALKSLSVVELTNSCSRESMILTIMNSIRDLPDLELENIRSQLLRDFSPDDVCPSSAHFLESPGKIAPPCSDDDTDYDYQEAELIDLRNDNNTYLEASATTLAAIAIPVPTTNLLSIDELLETVVNDVSSQTGGQCLVSMAGDIPFQEMTSHCEAFSMGKHHKMSLLMSFKQNKQAAMVVVPDNQVSHAEAAHTSDKQSTNPFLLQSISAGEAQVAGDVQQPFLRLPPSSPYDNFLKAAGC

SEQ ID NO: 363 - protein, 922 aa, Zea Mays
MPLLANSLLSIIQTLLDQSRQDDMCIIGCETLFDFIVTQVDGTYQFNLEEFIPRLCKLSQIVRDKEKANALRAAALQSLSAMIWFMGELSHISSEFDSVVQVVLESYEPRQVQSDNSATENPGCQLVEEVLKPEGHASPSTFIFSVIPSWDSIVSDYGGIQLLMDDAKDPYFWSRVCVHNMAKLSREATTFRRVMESLFCHFDNTNSWSSKNGLALCVLLDMQMFMEKSGTNINLMISVLVKHLEHKAILKQPEMQLSIVEVITALAEQSRAQASAATIVAISDLVRHMKKTLHLALGSNDLEVVKWNDKLRMAFDECIVQLSKKVGDAGPVLDMMSVMLENISHTPLIAIATTSAVYRTAQIIASIPNLSYKNKVFPEALFHQLLLAMVHPDHETRVGAHRIFSVVLVPSSVSPFPNLKSLDQCRKHDVQRTLSRVVSVFSSSAALFDKLRRDRNSFREYLHEGSMNRILHGIDDEIATPNDLPGSQSLRQSLRLSSVSHKHSYTSLKEGQSPLTESINEMETIVLRLSSQQATLLLSSIWRQALSPKNAPQNYEAIAHTYSLLLLFLGSKTPIFEVLAPSFQIAFSLMSHSLGGTDSLPPSRRRSLFTLATSMIVFASRAFNVAPLLPICKLMLNDGTMDPFLHLVHENKLQAVKDYTEDPSTSYGSPEDNQNALKSLSVVELTNSCSRESMILTIMNSIRDLPDLELENIRSQLLRDFSPDDVCPSSAHFLESPGKIAPPCSDDDTDYDYQEVHGNFEQAELIDLRNDNNTYLEASATTLAAIAIPVPTTNLLSIDELLETVVNDVSSQTGGQCLVSMAGDIPFQEMTSHCEAFSMGKHHKMSLLMSFKQNKQAAMVVVPDNQVSHAEAAHTSDKQSTNPFLLQSISAGEAQVAGDVQQPFLRLPPSSPYDNFLKAAGC

SEQ ID NO: 364 - protein, 909 aa, Zea Mays
MPLLANSLLSIIQTLLDQSRQDDMCIIGCETLFDFIVTQVDGTYQFNLEEFIPRLCKLSQIVRDKEKANALRAAALQSLSAMIWFMGELSHISSEFDSVVQVVLESYEPRQVQSDNSATENPGCQLVEEVLKPEGHASPSTFIFSVIPSWDSIVSDYGGIQLLMDDAKDPYFWSRVCVHNMAKLSREATTFRRVMESLFCHFDNTNSWSSKNGLALCVLLDMQMFMEKSGTNINLMISVLVKHLEHKAILKQPEMQLSIVEVITALAEQSRAQASAATIVAISDLVRHMKKTLHLALGSNDLEVVKWNDKLRMAFDECIVQLSKKVGDAGPVLDMMSVMLENISHTPLIAIATTSAVYRTAQIIASIPNLSYKNKVFPEALFHQLLLAMVHPDHETRVGAHRIFSVVLVPSSVSPFPNLKSLDQCRKHDVQRTLSRVVSVFSSSAALFDKLRRDRNSFREYLHEGSMNRILHGIDDEIATPNDLPGSQSLRQSLRLSSVSHKHSYTSLKEGQSPLTESINEMETIVLRLSSQQATLLLSSIWRQALSPKNAPQNYEAIAHTYSLLLLFLGSKTPIFEVLAPSFQIAFSLMSHSLGGTDSLPPSRRRSLFTLATSMIVFASRAFNVAPLLPICKLMLNDGTMDPFLHLVHENKLQAVKDYTEDPSTSYGSPEDNQNALKSLSVVELTNSCSRESMILTIMNSIRDLPDLELENIRSQLLRDFSPDDVCPSSAHFLESPGKIAPPCSDDDTDYDYQEVHGNFEQAELIDLRNDNNTYLEASATTLAAIAIPVPTTNLLSIDELLETVVNDVSSQTGGQCLVSMAGDIPFQEMTSHCEAFSMGKHHKMSLLMSFKQNKQAAMVVVPDNQSTNPFLLQSISAGEAQVAGDVQQPFLRLPPSSPYDNFLKAAGC

SEQ ID NO: 365 - protein, 64 aa, Zea Mays
MAGDIPFQEMTSHCEAFSMGKHHKMSLLMSFKQNKQAAMVVVPDNQVSHAEAAHTSDKQVHGPA

SEQ ID NO: 366 - protein, 1280 aa, Zea Mays
MDSIDADLARTQEERRRMEEALAAGAPMAVSSVTFDTDLYGGGGADPNRFAGYDTSIPASEDDAAEDDAEAANPAPRRLAAYTGHAIAAADIPRSADDDDGLPKRSQRIIDREDDYRRRRLNQIISPERHDPFAAGEATPDPSVRTYADVMRDAALQKKKEDLLREIAKKKKEEEEKEKERKAAAPEQPAATTKRRNRWDQSQDGDAGAGAKKVKTSSDWDAPDATPGIGRWDATPGRVGDATPSVRRNRWDETPTPGRMADADATPAAGGATPGATPSGAWDATPKLPGGVTPTPGKKQRSRWDETPASMGSATPGSLGAATPAGYTPGPTPFGAENLATPTPSQIARGPITPEQYQLMRWERDIEERNRPLTDEELDAMFPQEGYKILEPPASYQPIRTPARKLLATPTPLGTPLYAIPEENRGQHFDVPKELPGGLPLMKPEDYQYFGTLLNEEEEEQLSPEEQKERKIMKLLLKVKNGTPPQRKTALRQLTDKAREFGAGPLFNKILPLLMQPTLEDQERHLLVKVIDRVLYKLDELVRPFVHKILVVIEPLLIDEDYYARVEGREIISNLSKAAGLATMIAAMRPDIDNIDEYVRNTTARAFSVVASALGIPALLPFLKAVCQSKKSWQARHTGIKIVQQIAILMGCAVLPHLKSLVEIIEHGLSDENQKVRTITALSLAALAEAAAPYGIESFDTVLKPLWKGIRSHRGKVLAAFLKAIGFIIPLMDALYASYYTKEVMQVLIREFQSPDEEMKKIVLKVVKQCVSTEGVEADYIRNDILPDFFKHFWVRRMALDRRNYKQLVETTVEMANKVGVADIVGRVVEDLKDESEPYRRMVMETIEKVVANLGASDIDARLEELLIDGILYAFQEQTSDDANVMLNGFGAVVNALGQRVKPYLPQICGTIKWRLNNKSAKVRQQAADLISRIAIVMKQCQEEQLMGHLGVVLYEYLGEEYPEVLGSILGALKAIVNVIGMTKMTPPIKDLLPRLTPILKNRHEKVQENCIDLVGRIADRGAEFVPAREWMRICFELLEMLKAHKKGIRRATVNTFGYIAKAIGPQDVLATLLNNLKVQERQNRVCTTVAIAIVAETCSPFTVLPALMNEYRVPELNVQNGVLKSLSFLFEYIGEMGKDYIYAVTPLLEDALMDRDLVHRQTAASAVKHMALGVAGLGCEDALVHLLNYVWPNIFETSPHVINAVMEAIEGMRVALGAAVILNYCLQGLFHPARKVREVYWKIYNSLYIGAQDALVASYPALEDDGDNIFSRPELAMFV

SEQ ID NO: 367 - protein, 1280 aa, Zea Mays; identical to SEQ ID NO: 366

SEQ ID NO: 368 - protein, 1280 aa, Zea Mays; identical to SEQ ID NO: 366

SEQ ID NO: 369 - protein, 274 aa, Zea Mays
MGITGRRRGEHVGQGDGREATRSGLLLWREAAAEAGEEAGDGEIGECVNGLGIDWIGARALFFFVAFFVFLLDRRGLCWDLGISPRLAPQMNDPDRVNDQSTDEIQPPCQIFQPNACEGRASYLIFTLRPPKQTLPAPFPRRRRHGLDRRRSRAHARGAAQDGGGAGGWRAHGRVLRHLRHRPLRRRGRRPQPLRGLRHLHPGLRGRRRGGRRGGRQPCAAPPRGLHGPRHRRRRHPAVGRRRRRAAQEVPAHHRPRGRLPPPPPQPDHLAGAP

SEQ ID NO: 370 - protein, 1280 aa, Zea Mays; identical to SEQ ID NO: 366

SEQ ID NO: 371 - protein, 424 aa, Zea Mays
MGKHEFLTPKAIANRIKAKGLQKLRWYCQMCQKQCRDENGFKCHCMSESHQRQMQVFGMAPDRVVEGFSEEFLESFLSLIRRAHRHSRVAATVVYNEYIADRHHVHMNSTRWATLTEFVKFLGREGYCKVEDTPKGWFMTYIDRDSEQAVKERLKRKRIKSDMADDERQERMIARQIERAHKSLAKPNGGGAAEGEPESGSEGEYSGSDDDEQEPEDDSKEADKATGKIAIALQKAVPGPKVNPFDDKPKMKFGFDEEDGSGTRDQEKNELTKKMGKDVKAAEAKRSALDELMKEEEKAKERSNRKDYWLCPGIVVKVMSKSLAEKGYYKQKGVVKKVIDKYVGEIEMLESKHVLRVDQDELETVIPQIGGLVRIVNGAYRGSNARLLSVDTEKFCAKVQVEKGLYDGKVLRAVEYEDICKISS

SEQ ID NO: 372 - protein, 575 aa, Zea Mays
MAGFARATAPASPSPAAALLTGERLVVFLFAARVALAAPVHLAAALAVLVAAALAVELAVDGSGSAPLRRFRTRPGASSGILLGATTLPSVMLSRLIQLSRLLPADPNGPKEFAYLEMQYWAASISCLSVLALFLWHLQKSPSNGISKHLEYGSLFIVLYLMTFFLSFLLKTDEGLMVTTNMAYMLCHGVAAVILIKHILEKFPSCASFGEALLVSGGLVLYFGDMLAHTLSKMEFSMSSKAFIHTPQTRSDMTAIIQGILLVLFLLPLLYKSSLKVWYCWTKERKQQTQTPEEHKRIRIDSAIFYISLAVVLIFLLPSWTHLVQGLKVHPFVWIVNYMFTDSHERLVLCAYWICVIYVSVRRFYSISKQSKTERILLRKYYHLVAVLIFSPAVIFQPAFLDLAFGAAFAVFLILEMLRIWEIYPLGRVVHQFMNAFTDHRDSEILIVSHFSLLLGCALPKWMSSGLNDRPLAPFAGILSLGIGDTMASMIGYKYGVLRWSKTGKKTIEGTAAGITSVLAACSILVSLLASSGYILSQNWLSLLIAVTLSGLLEAYTAQLDNAFIPLVFYSLLCL

SEQ ID NO: 373 - protein, 226 aa, Zea Mays
MQGDPGYGGYGYGYGYDVAGNGGGGGYYPANDRYPAAAYEDPLAGRRQPLLTGLEFEPSDTCPRNYVIFDQTYDRSRVMYHPSLPADNFDHQGYYSGESAYHGGGGSGGSVRQKEDTDEIDALMSTEDGGGDDDEDDVLSTGRTPGCRAAGSPDSTCSSGGGRKHEAPAGGEKKKERVKKMVRTLKGIIPGGDRMDTPAAVLDEAVRYLKSLKVEVNKADARGSGS

SEQ ID NO: 374 - protein, 378 aa, Zea Mays
MDDQVYMQPEDNRMRRLSEDTLLCDSEESLTKRKLDFSQPIGGDNSTATLIPYPTITGNEDFVPSSSDVAQVGDGDDDVTNFCLTRREPPTCDVAQVGDGDDDVTNFCLIRREPPTSPFIDSCVDTTELAEDYSSFPCALPSVVNFSDIDSFLDGCDQLFENQTLDIISPVEIHPSMDTVATLEDLFLKTTRQALANVLDGLNAHTLRDPVRCASLRLASSCLTGQFASIARIKAMLDKLITISEQLQRTYSNFEVARKQDEQSTAKIKQALDVQREALRTVDDELASAEKQRAETMTTIEKLNQILMEVEQKRARLEEMRSTSDLEVRKLEQDLCDAIADASKKAIDVFQKETTELNQQAEQLLIDLNSCRCRSSSN

SEQ ID NO: 375 - protein, 247 aa, Zea Mays
MAGRVQDFITLRIGSLWLDVPLGPLHASDSAGSLRTTAASPAMIGLEQEVNSKPHDGFIPVVSKAAKRRARRMAARSRASASQEHPNKVHKVAFSSSGPPGFSKPKVNKSVDHKAEAKFRQTTLGEWPVCIKQAPPTKFVQSRASSTSTPKETTPTLTPPNMLGVRSSKLVPSILGAPPTKIVTTTNPISPNEEVVLVDQHQHPQPCNKGKAAMVEKEVLQPSMDKGKEVVMEYNTSSSKNESHTRP

SEQ ID NO: 376 - protein, 668 aa, Zea Mays
MTDHARENGCKPPDPSLENQLAFLRCKGSQQRTGYMKGWENYDIEYIPIPSGYAEWGTIILAKHSFNLRGDGEVDGEFYEEYVPSHHEREPSMLLYPKCLSQLLEVWDELQVGGEVSLQEWRDNICIAEPYHPDRVTRQFRLDQVVPYLVLKSVYTEDDFGVAYSYWAHLLRPINQDFSCLPNETRIGSCTIYWINWYRKFSEPFISVLTNLRCGCARGRVHYNDRKRLAAGKIIPRRLSPSDFVVIREVREEQHTKYIAFIKAREEHSEINLMEGSSLQHVPTDNTSQKDSMDDQVYMQPEENRMWRLSEDTLLCDSEESLTKRKLDFSQPIGGDNSTATLIPYPTITGNEDFVPSSSDVAQVGDGDDDVTNFCLTRREPPTCDVAQVGDGDDDVTNFCLIRREPPTSPFIDSCVDTTELAEDYSSFPCALPSAVNFSDIDSFLDGCDQLFENQTLDIISPVEIRPSMDTVATLEDLFLKTTRQALANVLDGLNAHTLRDPVRCASLRLASSCLTGQFASIARIKAMLDKLITISEQLKRTFFNFEVARKQDEQSTAKIKQALDVQREALHTVDEELASAEKQRAETMMTIEKLNQILMEVEQKRVRLEEMRSTSDLEVRKLEQDLCDAIGDASKKAIDVFQKETTKLNQQAEQLLIDLNSYRSSSN

SEQ ID NO: 377 - protein, 102 aa, Zea Mays
MLGLVCSHCNLCISSSFHGSLVDVSGSNYHIFIIHNHAFRVHIHHESPIIPSLVLIGYPSCSIIVFFWGNQYLLQFWAFLKCTGISSRKQNNSMQSNLWVTG

SEQ ID NO: 378 - protein, 89 aa, Zea Mays
MVPQPPTPSSVLPSAMTPGRRCSISDRTRPALLAAPLSLIPAPSLASICLQVAVSSSVLPCAHASSFAWPVVVLTALGCSSSSPDRATS

SEQ ID NO: 379 - protein, 250 aa, Zea Mays
MAIDDIGVSARRFPFDEDDGMTIRLGFLSSTNAGCWDGADARPQTKDDALAMKAEQGTQPSAVRTTTGQAKELACAQGRTEELTATCKQIDASEGAGIRDRGAANRAGRVRSEMEQRRPGVMAEGRTELGVGGWGTMGTSLRRRGCGELPTAQQGQGPTSGSGGGPLELDAGQARQREGLGERSSKARSRSGELESHGWEEQRPSWGRDQGRTHQRRRAAAASKGARAGAPNRRRESRAGRDRGSSRAHG

SEQ ID NO: 380 - protein, 161 aa, Zea Mays
MKFGDLASALRISLQLEKSVQYVKQVYTATDDLLLKKQFSYLIARHGLAMEIDDEISTDDNDKEALQEIVNNTKLSEGYLTLARDIEVMEPKSPEDIYKVHLIDGRGASSSLDSARQNLAATFVNAFVNAGFGKDKLMTAPSDSPSSGSSGNWLFKNKEHG

SEQ ID NO: 381 - protein, 420 aa, Zea Mays
MEYIGKDDSNIRIGAILGLGIAYAGSQKEELKMHLSAVLGDSQSPLEVLVFSAIALGLVFVGSCNEEIAQSIIFALMERSEAELAEPIIRLLPVALGLLYLGKQDSVEATAEVSKTFDEKIGKYCDVTLMSLAYAGTGNVLKVQKLLGICSQHLEKGETHQGPAVLGIALIAMAEELGAEMAVRSLERLLQYGEQNIRRAVPLALGILCISNPKVNVMDTLSRLSHDADADVSMAAIISLGLIGAGTNNARIAAMLRNLSSYYYKEAAHLFCVRIAQGLVHLGKGLLTLSPYHSDRFLLSPMALGGLVTVLHACLDMKSTILGKYHYILYIIVLAMQPRMLLTVDEDLKPLSVPVRVGQAVDVVGQAGRPKTITGFQTHSTPVLLAAGERAELATEKYIPLTPVLEGFVILKKNPEYHEE

SEQ ID NO: 382 - protein, 111 aa, Zea Mays
MDEKQANTPRRLTPKKDMVTLSSGSDASPGNSLSRAHEDNHEEGSLSTAKRKNAQQTKTKKTKDAGTKTGADQAGNGDAEDDVQDKLTGNSVKCQLTHLSILFFLLLQIWM

SEQ ID NO: 383 - protein, 186 aa, Zea Mays
MGDEEDDPDWLRAFQAPTVAPVMLSSGSDTSPEASPTRTSTSRKQNKGEKHASPDHARDRDGASQNKNKISAATRRKNLVSKKEGSTMDEKQANTPRRLTPKKDMVTLSSGSDASPGNSLSRAHEDNHEEGSLSTAKRKNAQQTKTKKTKDAGTKTGADQAGNGDAEDDVQDKLTGNSVNCISAAL

SEQ ID NO: 384 - protein, 354 aa, Zea Mays
MGDEEDDPDWLRAFQAPTVAPVMLSSGSDTSPEASPTRTSTSRKQNKGEKHASPDHARDRDGASQNKNKISAATRRKNLVSKKEGSTMDEKQANTPRRLTPKKDMVTLSSGSDASPGNSLSRAHEDNHEEGSLSTAKRKNAQQTKTKKTKDAGTKTGADQAGNGDAEDDVQDKLTGNSVSQRLPLIFPDKVQRSKALIECDGDSIDLSGDIGAVGRIVVSNGPTAKQDLLLDLKGTIYKTTIVPSRTFCVVSVGQSEAKIEAIMNDFIQLEPQSNLFEAETMVEDEEGDKLYEPQANQNDLNNNEDEGQPKAKTKRKAEKTTGKAPKKAKVAGKGPKKGTRKTQPAKRGRKAKK

SEQ ID NO: 385 - protein, 364 aa, Zea Mays
MGDEEDDPDWLRAFQAPTVAPVMLSSGSDTSPEASPTRTSTSRKQNKGEKHASPDHARDRDGASQNKNKISAATRRKNLVSKKEGSTMDEKQANTPRRLTPKKDMVTLSSGSDASPGNSLSRAHEDNHEEGSLSTAKRKNAQQTKTKKTKDAGTKTGADQAGNGDAEDDVQDKLTGNSVSQRLPLIFPDKVQRSKALIECDGDSIDLSGDIGAVGRIVVSNGPTAKQDLLLDLKGTIYKTTIVPSRTFCVVSVGQSEAKIEAIMNDFIQLEPQSNLFEAETMVEGTLDGFTFDSDEEGDKLYEPQANQNDLNNNEDEGQPKAKTKRKAEKTTGKAPKKAKVAGKGPKKGTRKTQPAKRGRKAKK

SEQ ID NO: 386 - protein, 111 aa, Zea Mays; identical to SEQ ID NO: 382

SEQ ID NO: 387 - protein, 198 aa, Zea Mays
MGDEEDDPDWLRAFQAPTVAPVMLSSGSDTSPEASPTRTSTSRKQNKGEKHASPDHARDRDGASQNKNKISAATRRKNLVSKKEGSTMDEKQANTPRRLTPKKDMVTLSSGSDASPGNSLSRAHEDNHEEGSLSTAKRKNAQQTKTKKTKDAGTKTGADQAGNGDAEDDVQDKLTGNSVKCQLTHLSILFFLLLQIWM

SEQ ID NO: 388 - protein, 111 aa, Zea Mays; identical to SEQ ID NO: 382

SEQ ID NO: 389 - protein, 24 aa, Zea Mays
MAVRRVVSSTSCSTCFREREHVKL

SEQ ID NO: 390 - protein, 753 aa, Zea Mays
MADLPPSKPALPSHPLTQSFPPSSDAPSHLSPSPAFSPNSASTPTFSQALEPSHSGVSSQVGRSKFQRWSDGGGGPFSGEPCSYKDATLIQLSAVPSSPSRGSQLRSAKEVVVRGHVEDLRQAVSGRRQEGLTPYSLFPLSSSWASSKEVSLSSPGRERDVWKATKMSVWQRIGPQLPPSKFSHSPAAEASLVESNISSHSGKKKRRRAKCHKEVSWQSTAPVGAASTLEPSPGVGTQSRVKTCVLEFSTAMAREEAALRRALFVSIVGSRPEISGAEVRDEVARAFGIDVNSISIHQSLPEDFLLLLPDESSADRVFSGGKLFRGPLFNLQFRRWSRLAHAEAARLPALVEVEVHGIPAHAWDRSTAEYLLRDSCIITDIHPSTSLKNDLSSFRLCAWCSNTDLFPRSMKLLIVEPGTDVHEKRCLSYDIEVAVTAVMEVPPPVRRLAVNSVAGVEEVASSMGRAVHSPSWLAAGTGTEAHIGRMLAADIGTETHSGGMLVVSIGAEAHTGSMVVVPAREVLAVHMELTAADMGTGPGTDCAKLCNSRRWMGTGGHVDKVGWVAETAWVGLSPTEVLESPRLKVYSRLKKGRLQIPASVSSQMEVSAPVLDLVPAGVSSQLEEATPVMKLVANITRDIDCLLPQPPIQKRRTKQLPPDFVPRHSSRLSKKREGLNSTVRQVQAELMLKLNVTNSQVAVTDEMLEEFGQLFDKPLSNSHIKALAALFGWPVPDNVQECLDVPLLRELSIETCA

SEQ ID NO: 391 - protein, 228 aa, Zea Mays
MKLRYIPVLYATFWKYAYMRVCKNIPSELPDPTSSFFNRLTSSLEPVDFTGEDLLVIAADQPFRFPSTFTFVVRAFSVLDGIRKGLDPRFHITEIAKPLHIFTYPIVSTIGYVRCRDNELCSAAGAKVVVTDQARMSNRTALVLSAAAYAAIASAGKAARLRDRRVVDVEYKRVPYEYAKDRNLSIRVEEKIRPPSNLSIRILYQGGQTDIVAVDVATGARKGAACSS

SEQ ID NO: 392 - protein, 142 aa, Zea Mays
MHSSENKLGWNETSMGLVPVPKRPARPDASHQCKSDSFMKRSPRKVRNATLAKSIKSKYHYSPLKQRKGSDSVPGKIVTGLTARKKKKRKIQITDEATRLERRARYFLIKIKLEQNLLDAYSGDGWNGQRCIPCSFCCNLLV

SEQ ID NO: 393 - protein, 527 aa, Zea Mays
MHSSENKLGWNETSMGLVPVPKRPARPDASHQCKSDSFMKRSPRKVRNATLAKSIKSKYHYSPLKQRKGSDSVPGKIVTGLTARKKKKRKIQITDEATRLERRARYFLIKIKLEQNLLDAYSGDGWNGQSREKIKPEKELQRARKQIIKCKIAIRDIIRQLDLYTSTGSVDDPLMPTDQSTNPEHTMCSTCKSHESFPSNKIIFCKGPCKRACHEKCLEPPLNKSVLPTSSHGWLCKFCLCKVRILETINAHLGTSFTVKCHFEDIFKETTELIDSEDALDEDWLSEYSGDEDYDPDENEASGDCMDSGEKIMSDDSNGSGSPLYSPNDDIPDFISADLNVVEGFCHTNLDLGIDAVEDDFAQILTYQRPRRDVDYRRLNEEMFGKITGNEEQSEDEDWGHERRKKRTHSGVAGDNSVGFLNVISDEKSQKKGRKLFRIPPAAVEVLRRAFAENELPPRDVKENLSRELGISFEKIDKWFKNTRCAALRDRKAEGNSHNTAPSKSSKNKGKAGISDWKEWSCYWSLQ

SEQ ID NO: 394 - protein, 721 aa, Zea Mays
MHSSENKLGWNETSMGLVPVPKRPARPDASHQCKSDSFMKRSPRKVRNATLAKSIKSKYHYSPLKQRKGSDSVPGKIVTGLTARKKKKRKIQITDEATRLERRARYFLIKIKLEQNLLDAYSGDGWNGQSREKIKPEKELQRARKQIIKCKIAIRDIIRQLDLYTSTGSVDDPLMPTDQSTNPEHTMCSTCKSHESFPSNKIIFCKGPCKRACHEKCLEPPLNKSVLPTSSHGWLCKFCLCKVRILETINAHLGTSFTVKCHFEDIFKETTELIDSEDALDEDWLSEYSGDEDYDPDENEASGDCMDSGEKIMSDDSNGSGSPLYSPNDDIPDFISADLNVVEGFCHTNLDLGIDAVEDDFAQILTYQRPRRDVDYRRLNEEMFGKITGNEEQSEDEDWGHERRKKRTHSGVAGDNSVGFLNVISDEKSQKKGRKLFRIPPAAVEVLRRAFAENELPPRDVKENLSRELGISFEKIDKWFKNTRCAALRDRKAEGNSHNTAPSKSSKNKGKAGISGKTGRNGHVTGPCNNLRTNEEKTGISGKFDSGDNSCLVPFSEVINVPTRLPHNFEMRKMESTRSPARLHNKGGFLSATVQIKESTLLPTGKPCWQSEMSHPTTNEVSTSAQATTWIDAGACAEEQEPTPWVDIGVSDYQPFLDVIDDMCGLEWRLQRLKENMLSSSIDGQTAASESDKRNQTVVLVPTAELKEKLPHDGLFGHYCP

SEQ ID NO: 395 - protein, 535 aa, Zea Mays
MCSTCKSHESFPSNKIIFCKGPCKRACHEKCLEPPLNKSVLPTSSHGWLCKFCLCKVRILETINAHLGTSFTVKCHFEDIFKETTELIDSEDALDEDWLSEYSGDEDYDPDENEASGDCMDSGEKIMSDDSNGSGSPLYSPNDDIPDFISADLNVVEGFCHTNLDLGIDAVEDDFAQILTYQRPRRDVDYRRLNEEMFGKITGNEEQSEDEDWGHERRKKRTHSGVAGDNSVGFLNVISDEKSQKKGRKLFRIPPAAVEVLRRAFAENELPPRDVKENLSRELGISFEKIDKWFKNTRCAALRDRKAEGNSHNTAPSKSSKNKGKAGISGKTGRNGHVTGPCNNLRTNEEKTGISGKFDSGDNSCLVPFSEVINVPTRLPHNFEMRKMESTRSPARLHNKGGFLSATVQIKESTLLPTGKPCWQSEMSHPTTNEVSTSAQATTWIDAGACAEEQEPTPWVDIGVSDYQPFLDVIDDMCGLEWRLQRLKENMLSSSIDGQTAASESDKRNQTVVLVPTAELKEKLPHDGLFGHYCP

SEQ ID NO: 396 - protein, 485 aa, Zea Mays
MSSSCMPTGLRLDLDMVKAAASPGAHSSPLRPVHSSPSSTLSEASNASSSATSVSLKRARAPRKRPNQAYNEAAALLASIHPSVFPVKKSPKTAPPRPPSSRQLSGLAAALDASSSDLLPPLPVLADSAFLLRDIPAPSPLPQPQSPSAAKNCSSPAPVSSAFRDFRDPAPSPASPDTVDVNELGEIDFDDDGFDAESILDVEEAAAAAEGLDGIMGSLTVESNSTAATTSDDSILSSSGIHPYLRSLMVVGLAGRFELGLGSRHGARPNLNRALKRRDDDGAWWMWPAVPVKDLTVAPPTPPASNAAVSQPQPAAAPEKNKSKKKKVVKVEKVMMGAKGKEELLPSAKCKEEEADGDGDAESAPVKAPKTGLGLKLDADEVLKAWSDRGSMFAEGSAPESPTSVAEARAKLSDMDLFPENEAGAGAGGVREASVLRYKEKRRTRLFSKKIRYQVRKVNADCRPRMKGRFVRSPSLLRQALEEES

SEQ ID NO: 397 - protein, 370 aa, Zea Mays
MAMMVDPPNGIGNQGKHYYSMWQTLFEIDTKYVPIKPIGRGAYGIVCSSINRETNEKVAIKKIHNVFDNRVDALRTLRELKLLRHLRHENVIALKDIMMPIHRRSFKDVYLVYELMDTDLHQIIKSPQGLSNDHCQYFLFQLLRGLKYLHSAEILHRDLKPGNLLVNANCDLKICDFGLARTNSSKGQFMTEYVVTRWYRAPELLLCCDNYGTSIDVWSVGCIFAELLGRKPIFPGTECLNQLKLIVNVLGTMSEADLEFIDNPKARRYIKSLPYTPGVPLVSMYPHAHPLAIDLLQKMLIFDPTKRISVTEALEHPYMSPLYDPSANPPAQVPIDLDIDENISSEMIREMMWQEMLHYHPEVATAISMS

SEQ ID NO: 398 - protein, 181 aa, Zea Mays
MTEYVVTRWYRAPELLLCCDNYGTSIDVWSVGCIFAELLGRKPIFPGTECLNQLKLIVNVLGTMSEADLEFIDNPKARRYIKSLPYTPGVPLVSMYPHAHPLAIDLLQKMLIFDPTKRISVTEALEHPYMSPLYDPSANPPAQVPIDLDIDENISSEMIREMMWQEMLHYHPEVATAISMS

SEQ ID NO: 399 - protein, 370 aa, Zea Mays; identical to SEQ ID NO: 397

SEQ ID NO: 400 - protein, 136 aa, Zea Mays
MASSPSSSRITAASSHSHGRAHLPAASSPTISPTQISIPLAAARRELSLAFSPVGALFPCGSHGAGEARAAAHPTMVPLFFPAVQLPVPLSHGAPSGLAAGTALFPFDCFPDTGAVSSPMADALCSIPSMAGAQQQ

SEQ ID NO: 401 - protein, 410 aa, Zea Mays
MHDGWRAGLARIGTTDGMTMTNRKSTTGETDSRTGIELTGIAQIDDARPDLVSTTQRWASLPLLRHEVLAAEADEHNGGRGLGIEPAHHAVWKPHHPHEALAAEHQTARHSRRAPKSRAELGAKASAASELRGHVRKLNGGDLGERDTGDQSERCADEEAGSRDEGARRADWASWARRGETGELGWGWLRENRGAESSARRRGRVGREASAREARVATRAGGRADDEQEVASPEEQGRWVSYRGRSSALGSCRAGKKPAARGKQRAGTRARDIRWRSRTLPRPWKAGAAGLGDPGTRREQDAPWEHGGEAARLGGEKRSSAGGCLKKEQRTLALRAGPSSAAMAEQRAEQGRGRRNSGSARLEEARRAERTGGSSAAMAGARGRQRASATERRKILGTRAQGVRHGAAGD

SEQ ID NO: 402 - protein, 670 aa, Zea Mays
MDHGGEGRVAAARRTLRAGVDKSRALGHSLARAGPRLEEIQAALLALEAAVRPIRAPHAELAAAGPHIDRAVSPAAAVLKVFDAVHGLEPPLLAPGAAGSGAAGDLPGYLAVLAQLEEAHRFLADNCGLAAQWLADIVEYLGDRDLADQRFLADLGVTLDELRTPPAGDLDGGLLAAALSMLEAEFRRLLADHSAPLAMPQTGAAAGSATPSRVPAVAVHKLTLILDRLVANGRQDSCVASYIDARGGVVSASLRALGLDYLRDPSQDAQALGPALDLWRRHLEFVVRRLLDSERQLCAKVFGQHKDVASACFAEVAAQAGVLDFLRFGRAVADAKKDPIKLQRLLEVFDSLNKLRLDFNRLFGGKACAEIQSQTRDLVKLLIDGAVEIFEELIVQVELQRHMPPPVDGGVPRLVTFVVEYCNRLLGEQYRPVLGQALTIHRSWRKEAFNDRMLVDAVLNIVKALEANFDVWSKAYDNATLSYLFMMNTHWHFFRHLKATKLGEVLGDVWLREHEQYKEYYLSMFIRESWGALSALLNREGLILFSKGRATARDLVKQRLKTFNSSFDEMHRRQSSWVIPDKDLRERTCNLVVQTIVPTYRSYMQNYGPLVEQEGNASKYVRYTVDGLEKMLSALYMPRPRRAGSFQIKHSSGKIASAMTGLHRSASAVK

SEQ ID NO: 403 - protein, 268 aa, Zea Mays
MPPPVDGGVPRLVTFVVEYCNRLLGEQYRPVLGQALTIHRSWRKEAFNDRMLVDAVLNIVKALEANFDVWSKAYDNATLSYLFMMNTHWHFFRHLKATKLGEVLGDVWLREHEQYKEYYLSMFIRESWGALSALLNREGLILFSKGRATARDLVKQRLKTFNSSFDEMHRRQSSWVIPDKDLRERTCNLVVQTIVPTYRSYMQNYGPLVEQEGNASKYVRYTVDGLEKMLSALYMPRPRRAGSFQIKHSSGKIASAMTGLHRSASAVK

SEQ ID NO: 404 - protein, 114 aa, Zea Mays
MPGEWSVGLCDCFGDLHTSCCMSGTLYYLLSTIGWQWLYGCAKRSSMRSQYSLRESPCMDCCVHFWCGPCALCQEYTELQKRGFHMAKGWEGSNKVVGCFHGMTTPPRKQSMCF

SEQ ID NO: 405 - protein, 250 aa, Zea Mays
MEVASGDEDLESLLQNFHRVSQGYKDALMQVQVLRVNCSTEFKRREALESHITDLKKDNERLRRQYTETLFKVTNQVKFRAEAQSLKEELDKANSRLLSMEEEHKRETEQLKHSSEMNINALENKLSHALVQQARDEAAMKQLKLELSAHKSHIDMLGSRLEQVTNDVHSQYKNEIQDLRDVVSVEQEEKKDIHRKLQNVENELRITRMKQAEQQRDSVSVQHVETLKQKVMRLRKENESLKRRLASSEV

SEQ ID NO: 406 - protein, 210 aa, Zea Mays
MEVASGDEDLESLLQNFHRVSQGYKDALMQVQVLRVNCSTEFKRREALESHITDLKKDNERLRRQYTETLFKVTNQVKFRAEAQSLKEELDKANSRLLSMEEEHKRETEQLKHSSEMNINALENKLSHALVQQARDEAAMKQLKLELSAHKSHIDMLGSRLEQVTNDVHSQYKNEIQDLRDVVSVEQEEKKDIHRKLQNVENECMFELNW

SEQ ID NO: 407 - protein, 436 aa, Zea Mays
MTIVPVTIYNRTPKRIRQIPVHPSLSLPLLPFGLFFLPPMEALTARSSVLSPPGIAGDTSPSLPLPLRRASAAFLGPRRSPSALAISTRWLRAPPRRGGRLLAGEGEEVPPDPADDAAGRAEDFLVLENNVTLRQSNDMDTIKHDDAGTSGIGGSNTGGSRTGLFRTPISGGVHSATAVHDLPPPALAVRNLMEQARFAHLCTVMSRMHHRREGYPFGSLVDFAPDPFGHPIFSLSPLAIHTRNLLADPRCTLVVQVPGWSGLSNARVTIFGDVIPLPTEQQEWAHQQYVSKHQQWASQQWGNFYYYRMHTISDIYFIGGFGTVAWVDVNEYEALQPDKIAMDGGEQNLKELNAMFSKPLKELLSTDEGEVDDVALISMDSKGIDIRVRQGAQFNIQRVPFEVDHSVETLDEATEALRRIISKSRWHTKSSVIGRP

SEQ ID NO: 408 - protein, 299 aa, Zea Mays
MTIVPVTIYNRTPKRIRQIPVHPSLSLPLLPFGLFFLPPMEALTARSSVLSPPGIAGDTSPSLPLPLRRASAAFLGPRRSPSALAISTRWLRAPPRRGGRLLAGEGEEVPPDPADDAAGRAEDFLVLENNVTLRQSNDMDTIKHDDAGTSGIGGSNTGGSRTGLFRTPISGGVHSATAVHDLPPPALAVRNLMEQARFAHLCTVMSRMHHRREGYPFGSLVDFAPDPFGHPIFSLSPLAIHTRNLLADPRCTLVVQVPGWSGLSNARVTIFGDVIPLPTEQQVCTKITTDVISFPEYHL

SEQ ID NO: 409 - protein, 231 aa, Zea Mays
MTIVPVTIYNRTPKRIRQIPVHPSLSLPLLPFGLFFLPPMEALTARSSVLSPPGIAGDTSPSLPLPLRRASAAFLGPRRSPSALAISTRWLRAPPRRGGRLLAGEGEEVPPDPADDAAGRAEDFLVLENNVTLRQSNDMDTIKHDDAGTSGIGGSNTGGSRTGLFRTPISGGVHSATAVHDLPPPALAVRNLMEQARFAHLCTVMSRMHHRREGYPFGSLVDFAPDPFGRK

SEQ ID NO: 410 - protein, 2655 aa, Zea Mays
MDHRGGGGGGGNKNRTDLLAAGRKKLQQFRKKKGKRGPGNKADADADAEAGEGAPKAAEESVPEPKSPVGLKLLAGEGGGGSTPFEEAERSQAEQCNGEGPGTAESSSVESSNAVQEQETVQEQETDDVSDAHHVGPSEQGISEHPESQTAGGRDLSLQATSGDSIGDDNVGRAQLGDVDSMELNASSEGNGADGDCNQLGEHQQVEMDAVERPTSSSFEEFTELPIHSQGIEADNIHGEGAQEMVMDVSGRPLDGDIQHDIEPTASAEIDAETALEESTVAASIVIPESTARGTEYERDTGYETDGVDKEALLEDPSMVHVSDEAVTIDDLSVQAKPTASADMPLCEQKGDPALSRSAVLQGIMPLHFEDIQNHMFSATLSRDFLQLQLDEAAGLYSDFTQQSSDNTTQLRVLLKETEESKLAVDRELHQCRHELSKVNIEKGQLELTMASLKEEINTSNTRCTYLESELHSSKESTEQIHSELANSRLLLEALQKENMELTASLAFEKEAKKEVEEQRDHLSSDNRKLLSELSGLELSLASVKEEMDASSSRCNVFECELRSSNENMNHTLTELANCQALLETLQKDNLELSANSASEREAKMKLQEDNLYLCNEKGKLSSNLRELNDKLEVSYAKHKQLESHVKDTETYFGQLTEQLIEENLYTSISIDIYQSTTKDLDTKYNIVLGQFQNIMRQELHLDSSEVTTENAERAIMTPRHDSHGNNQCLLNLVNANDSCNSTALLSLKGHLEVAKSDLHNLEKLLERISSRSDGRVLVSKLIKSFESKGSDDDTGLSEGEHDNLQKSTREMLSCLGEKFIAMSSDITKTEEYLAELCNKIELYVKSTVQHDRDRQCTVVLEAKMDELAGKLSNYKETIDNLHNQVAIVQQDANSNAGKLIDQAELLQKDAVERISILENERMSLSDLLSEVTNKLTSLGDAVFPSGSSEIEGLNFCTLSCVDLVARSFQSLQEKLEAAQIDNAQLNSSLVELRKAIGVAQERSEHADGIVKKLYDSLQELLCDSLGSSNEFGARYSVEEPIESQYGRLIAHLKNLLHDHHSALSTNAELELSLLSKCEEVEELNMRCSSLLKKLDEVCILNEELKSASSSKNVTLDKLHSRCLTVAEMLASCSANHSSTVQLISDIGEGSSKEDHILTTLLPCIEADVASCIEKFENAAEEIRLSKICLQEISIFDQISFEKWSYPLPTLIKEEVLPKICDLQDRFDQLNALNIQLETEVAVLKDGMKELDEDLGTSRSELQKKVSELEQLDQKFSSVKEKLSIAVAKGKGLIVQRDSLKQSLLEKSGEIEKLTQELQLKETLLKELEAKLKSYTEADRIEALESELSYIRNSATALRDSFLLKDSVLQRIEEVLEELDLPEQFHSRDIVEKIELLSKMAIGTPFTLPDGDKGSSVDGHSESGVAMNVIDDEQNSNSNSVSDEVKSKYEELNRRFCELAEQNNMLEQSLVERNSLIQKWEEVLGQISIPPQFRMLEAEDKLAWLGNRFLEVEQERDSLQLKIEHLEDSSEMLIADLEESHKRISELSAEVVAIKAEKDFFSQSLEKLRFEFLGLSEKVVQDEFVRDKLRMDLSELRDKFAEKTEESRHYHEMDTEVHKLLNLVQNTLQDSTNSEISSGGISAVLCLGKMLKKLLDDYGTLLYKSTEGNFAERDIQLEDIKPSKDASKSDTGAYEKEMELNSLNNELDHAHNNLALAQQECDEAVEKAQSLMMEIETLHAQISKLQESDAEQMQKKEMELNSLNNELDHARNNLALVEQERDEAVEKAQSLMMEIETLHAQISKLQESDAEQMQKYQSLVLELESVGKQRDNLQERLNQEEQKCASLREKLNVAVRKGKGLVQHRDSLKQTMEEMNVVIEKLKSERKQHIESLETEKSSLMDRLAENEKSLHETNQYLSGLLNALNRVDVAREFDMDPITKVEKMAKFFLDLQSTVASSQNEVMKSKRATELLLAELNEAHERADNLQEELVKAEAALSESSKQYIVTESARADAVRQLELIMHAQSQTRRRQADHLLELNSTSSQLREVCFELSHCLVNTFSKDVDLICYVVNFMRSSGKLMDDTNTMDIPIASKHVLSNRTNNKKAHIPNAPLEIKTDDTDDSQFLHHLAIACHALSDCVKDCNDLKRNIDEHDFSVEQKATELFDVMSTLKNRFTSQHNELESLRAKFVELQSEMEERDKEIIFAQRNMSLLYEACASSVAEIEGISDIYPGKHSYAVEHSADECIKSIVEQLVMAVKTSQNSNEGSTKELKAIVLELQQELQAKDVQISTISSDLSYQLRVAESSAKQFSVDLEDARMELQNLEKQVDVLQNQKKDLETQLNELKNMESMASEQHGRIEKLTDELSRKDQEIEGLVQALDEEEKELEILENKSLQLEQMLQEKEFALKTSEVSRTKALAKLATTVDKFDELHSLSENLLAEVENLQLQLQERDSEISFLRKEVTKSTNELLTTEESNKNYSSQLNGFMKWLERELLQFGFHSESANDYDYTQFPVYMDMLDKKIGSLIAESDDLRVTVQSKDSLLQVERAKIEELMRKSDGLEASLSQKDSQIGLLRRDRASNQQSRSINLPGTSEIEQMNDKVSPAAVVTQIRGARKVINDQVAIDVEMEKDKPFDDEDDDKGSQAIDCS

SEQ ID NO: 411 - protein, 410 aa, Zea Mays; identical to SEQ ID NO: 401

SEQ ID NO: 412 - protein, 255 aa, Zea Mays
MEDFYEARIDDVDGEKIGMFGVYDGHGGVRAAEYVKQHLFSNLIKHPKFITDTKAAIAETYNLTDSEFLKADSCQTRDAGSTASTAIIVGDRLLVANVGDSRAVISKGGQAIAVSRDHKPDQTDERQRIEDAGGFVMWAGTWRVGGVLAVSRAFGDKLLKQYVVADPEIKEEVVDSSLEFLILASDGLWDVVTNEEAVAMVKPIQDPQEAANKLLEEASRRGSSDNITVVIVRFLYGTTGDKSGADKETTNDQNS

SEQ ID NO: 413 - protein, 149 aa, Zea Mays
MEDFYEARIDDVDGEKIGMFGVYDGHGGVRAAEYVKQHLFSNLIKHPKFITDTKAAIAETYNLTDSEFLKADSCQTRDAGSTASTAIIVGDRLLVANVGDSRAVISKGGQGKFLVGNMTYLNVFSYTSTCIGNFQIIICCVFSWTSISL

SEQ ID NO: 414 - protein, 98 aa, Zea Mays
MLSLTLKSRRRWSTAPLNSSSLLVMDSGMLSLMRKLLPWSSLFRTPRKQQTSFSKKRPEGEALITSPLSSSASYMELPVINQAQTKRPPMTKTPNYLL

SEQ ID NO: 415 - protein, 100 aa, Zea Mays
MRRRRWAPLAAACLVALAALLAAVHGGGGGGARGAAAPMPATRRPEASARVAAFDAARCKRQRNRAGAACAMLPAAAAAGGGGDDDKRVVPTGSNPLHNR

SEQ ID NO: 416 - protein, 76 aa, Zea Mays
MNILHVCSVHLRTRHELLSAGLFMPKSYRNERVELISIIHVRIYARMWRQEKVVWGALSYLHEIQPIQVMYSCGTA

SEQ ID NO: 417 - protein, 327 aa, Zea Mays
MASSRSLPRSASELPDPPSPFSSNPAHHPVSIPTTPGLSSSSCSSFGRMRSPPTDSPPITPTKQQGGKPKPTPAAAAAAYYASLWSPRRLMQRCARAFRRSRSRGGVVRTVKDLAEERAAVLAASSKVSDAASAVPPLPPGVETASSNGARGGSVEDKQRQRHDDCHPEVVPEKIIREDAPPVVAETAAATTTTEVEVEVESPKKGAAPVPEPIVVVAAVEDVVADKFVAVVKEAIKKPEMDEKEVAMRRFLGSRVKTAMEPRSEAEQPRRREVARSNDVIEAARTKLMQKRQCSRVKALVGAFETVIDTQKDAAAGRPQHIYRKSA

SEQ ID NO: 418 - protein, 93 aa, Zea Mays
MRVEFSLIWLPVVGSCRILMWKGELVVAPPPPRTWLLLIPALELGNRAQTLGLESDCGYRYDKYARSKLFLYVVGSQMPRADLFVCLLLMLMF

SEQ ID NO: 419 - protein, 566 aa, Zea Mays
MERYSDMRPKAEVSYLGRGSRFSSRNQSSEERTNHSSDKPGSSTRFNPTKARIGGNQGRPRYVCDSFKSPSSKVSPAGSSKFPLSKFEERRRQPFVPGFDIAESSRRKADAKQLQGSKKIAAENDSSDNLRGESEGFTTEQVVKPEGSHVVGHSGVSAYTVGSLVQTASLGSRTHRQKHKEVNLGTPGASSSTLTNRSTIPGNSTMGVRPAYGHVNGGQIHGLKNLGCSSVPDAQPSGCPSESVISRRRFEFMRKRAFDQESSSRSVNLSLGHSTPTDIRRIRMNEQSLCQQIPRSSSRSHQESAGSVRTRRPSPHATRMSVPDGRADGVLSLHESSTKDVQPAQEHLSLEEVSTESSIRPFFVEFDNNIFSSSHLRRSSTRAERGRPSSLFEESPRQMFHSLMGERDRHRHITMEGITEVLAALERIEQQAELTYDQLLMLEANLFFGAFASYDRHRDMRMDIDDMSYEELLALEERIGSVSTALSEEQFTKCLKRSIYSQVALEVNKSTVDDMKCIICQEEYAEGEEVGRLPCEHRYHVCCIGQWLGQKNWCPVCKASAVPSKG

SEQ ID NO: 420 - protein, 609 aa, Zea Mays
MEWDSDSDGGDDEEEEEVRPGGGDAGPGFSLAIEGVLGACGMVVSDALEPDFPIIYVNRGFESSTGYSAEEVLGRNCRFLQCRGPFAQRRHPLVDAAVVTRIRRCLDEGTEFHGDLLNFRKDCSPYMARLQLTPIYGDDEVITHYMGIQFFNDSNVDLGPSSGSVTKELARSTWIAPGNTDSPTPVGKGNLWEHSSLFLLSDEVICQKILSKLSPRDIASVNSVCKRLHHMTRNEDLWRMVCQNAWGTEATRALETVAGSRSLAWGRLARELTTLEAVAWRKLTVGGAVEPSRCNFSACAVGNRVVLFGGEGVNMQPMNDTFVLDLSASKPEWRHINVSAAPPGRWGHTLSCLNGSRLILFGGCGGQGLLNDVFILDLDAQHPTWREIPGLAPPVPRSWHSSCTVDGTKLVVSGGCADSGVLLSDTYLLDVTMERPVWREIPASWSPPSRLGHSLSVYDGRKILMFGGLAKSGPLRLRSSDVFTLDLSEDKPCWRCITGSRMPGAGNPAGVGPPPRLDHVVVSLPGGRVLIFGGSVAGLHSASKLYLLDPTEDKPTWRLLNVPGHPPRFAWGHSTCVVGGTKAIVLGGQTGEEWTLTEIHELSLASSLV

SEQ ID NO: 421 - protein, 893 aa, Zea Mays
MKLSAAVLFFSILLQYCTSSGQPDSRGFISIDCGIPENSTYQDLTSTILYVSDRGFVTSGENRNISAGYISPSLAQRYYTVRAFASGVRNCYTLPSLVAGNKYLVRAAFYYADYDGLSTPPVFDLYLGASLWHEVRFRDAAAINWMDVVAVAPTDFLQVCLVNKGTGTPFISGLDLRPLRSTLYPEANASQSLVMVNANRCNVGPTDKSVVRPTKAHFSGPTSRYPLDPHDRIWLAYGAVPAWTEASATSVVRNYLADPYDAPSAVMQSAATPSDGSVLSFSWDTSDDRSVDASSATYLLVLYFAELQRVSASGELRRQFDIAVDGTAWNREPYSPPYLFADSFSGTVQGQARHSVSLTATRNATLPPLLNAMEVYLVRPVDEAATDPGDAKAMIAIQEAYVVSKNWMGDPCAPKAFAWEGLDCTTDPPTGTPRITAFLLFPELGHEIKLTNSTTETFELFLTRTVTYTRDLSHNNLSGSIPDCLGQLPFLVFLDLSSNDLRGPVPYTLLQKSHNGTLSLRLSNNPNLSGNGSGPKKLNGAALLSAIIIPTVAATALSVTFIALLLRALKEQARRRAVDPTPRDETALLENREFSYRELKHITKNFSLEIGRGGFGAVFLGYLGNGNPVAVKIRSESSSQGGKEFLAEAQHLTRVHHKNLVSLIGYCKDKDHFALVYEYMPEGNLQDHLRLRGLEYLHVACKPALIHRDVKSRNILLTTGLGAKIADFGLTKAFSDSETHITTEPAGTMGYLDPEYVSGQSPVVPVDDSVSVHVGEWVQQSLDRGGGVESVVDPSMGRCERGDYDVNSVWKVADLALRCRREASRERPTMTDVVAQIRESVELEAARRSSASGAAAAGGGGGLRSCAGERDAFEVVEGSVGETAGAAPGPAMI

SEQ ID NO: 422 - protein, 526 aa, Zea Mays
MSDVSVRFVALALAAISLAAAAAAAHDYGDALRKSLLYFEAQRSGRLPYNQRVRWRGHSGLTDGLEQGVDLVGGYYDAGDHVKFGLPMAFTVTLLSWGVLEYGGGVAGAGELAHALQAIKWGTDYFVKAHTAPAELWAQVGDGDSDHYCWQRPEDMTTSRRAYKVDAEHPGSEVAAETAAAMAAASAVFRRAGDAHYAHLLLHHAQQLFEFADTHRGRYDESVDVVKSYYPSSSGYQDELLWAALWLHRATGRRDYLRYALDNAEAFGGTGWAVSEFSWDIKYAGLQVLASQLLVEAKEERLRLSAEEVAVVEQLRSNAEYYVCSCMNRNPGGAKHNAGRTPAGLLFIRPWNNLQYVSGAAFLLTVYSDVLASLGQPLRCGSGDDGGEPAAGDAGDVLAFAKSQADYILGTNPMRTSYLVGYGAAYPRRVHHRAASSASYRHDRDFIGCLQGFDSWYSARQENPHDLVGAVVGGPNGEDVFNDHRGAYMQTEACTYNTAPMVGVFSRLMQLEGQSPRPAPAPAEDL

SEQ ID NO: 423 - protein, 753 aa, Zea Mays
MDPPRGGTVIDPTKCRLMSVDEKRELVRDLSKSPESAPDRLQSWTRREIVEILCSDLGRERKYTGLSKQRMLDYLFRVVSRKSSGPVEHVHEKEKGKDKESILEPNTTNHQSPAKRPRKSDNPSRLPIITNNSAASDVTGPTNNLRFCQNLACRAILRDNFCRRCSCCICFSYDDNKDPSLWLSCSSDQHLQKDTCGFSCHLECALKDERTGILQSGQGKKLDGGYYCIRCWKQNDLLGCWKKQLVIAKDARRLDVLCHRIYLSHRILVSTEKYLVLHDIVDTALKKLEAEVGPLSGAPNMGRGIVSRLTVGAEVQKLCAQAVDAVESLFSGVSPASSKIQRPCMMRPNFVKFEAITQTSVMVFLDLVDCPMLAQEATSFNIWHRVAVTESYPSNPTGIILAPLKKLLVTWLAPATSYIFKVVAFKNSIELGSWEIRMKTSWQKDDPRGSMPGGTGLGQNSESPKANSDGQSDPSSEGVDSNNNTAVYADLNKSPESDFEYCENPEILDSNKASHHPSERINDLQNIQMAADGVTEVTELEEAPGLSASALDEEPNACVQTVLLRDSNPLEHNQRTVVPRSHDTSNILAGHELVIVGPRYSGSVPPTAPRSVENSKDNGGRASKPKPCDIVVQNGSSKPEREPGNSSNKRATDKMDDFGHKDSFSEVSYEYCVRVVRWLECEGYIETNFRMKFLTWFSLRATLQERKIVSVYVDTLIEDPVSLSGQLVDSFSERIYSKKRPSMPSGFCMDLWH

SEQ ID NO: 424 - protein, 457 aa, Zea Mays
MLWNHCSRVYLLLVQKFSVRGPCMMRPNFVKFEAITQTSVMVFLDLVDCPMLAQEATSFNIWHRVAVTESYPSNPTGIILAPLKKLLVTWLAPATSYIFKVVAFKNSIELGSWEIRMKTSWQKDDPRGSMPGGTGLGQNSESPKANSDGQSDPSSEGVDSNNNTAVYADLNKSPESDFEYCENPEILDSNKASHHPSERINDLQNIQMAADGVTEVTELEEAPGLSASALDEEPNACVQTVLLRDSNPLEHNQRTVVPRSHDTSNILAGHELVIVGPRYSGSVPPTAPRSVENSKDNGGRASKPKPCDIVVQNGSSKPEREPGNSSNKRATDKMDDFGHKDSFSEVSYEYCVRVVRWLECEGYIETNFRMKFLTWFSLRATLQERKIVSVYVDTLIEDPVSLSGQLVDSFSERIYSKKRPSMPSGSAWICGIKELQGLTVRFVGSIFGPFFCCRSLH

SEQ ID NO: 425 - protein, 471 aa, Zea Mays
MTCVRAEDAVSPAAADDVAAALVSRGGLIQKVAAGGGRRPAGSARSLQRSAHLATGDGNAPAPAVEASCSWSGDGIGKSNGGGKRDDRHRMRQYRSQLEQEVKKLQRQLEEEVDLHVALADAVTQNVAPILKSSMKLPHKAQELLINIASLEITVSNLEKKLNDLYYQLCHERNERLLAENNQGCLPSTSSDEHQSLSTCTCTWEEHISSLRDLKFGGSESMRSMRQDLFPELEDDQDMGEDPEGQQIVSLNRLLEKHRDSSLNRLLEKHRDEEMQESGSMENEGNENEQPDTLSFEQSILKITSIKGGNLWSNPNELSEEMVRCMRNIFLRLSESLKISPKTSSDCSSSSVERLSGSTLASFSDSSIMPSMLRSPSVDSNHNDETMKEVRNFDPYKVNGKETRRDIGNYRSAAEVSWMSVGKDQLEYASEALKKFRFAATALAKPMSPHRYITCLQTVQTLVHIYKNFSI

SEQ ID NO: 426 - protein, 687 aa, Zea Mays
MTCVRAEDAVSPAAADDVAAALVSRGGLIQKVAAGGGRRPAGSARSLQRSAHLATGDGNAPAPAVEASCSWSGDGIGKSNGGGKRDDRHRMRQYRSQLEQEVKKLQRQLEEEVDLHVALADAVTQNVAPILKSSMKLPHKAQELLINIASLEITVSNLEKKLNDLYYQLCHERNERLLAENNQGCLPSTSSDEHQSLSTCTCTWEEHISSLRDLKFGGSESMRSMRQDLFPELEDDQDMGEDPEGQQIVSLNRLLEKHRDSSLNRLLEKHRDEEMQESGSMENEGNENEQPDTLSFEQSILKITSIKGGNLWSNPNELSEEMVRCMRNIFLRLSESLKISPKTSSDCSSSSVERLSGSTLASFSDSSIMPSMLRSPSVDSNHNDETMKEVRNFDPYKVNGKETRRDIGNYRSAAEVSWMSVGKDQLEYASEALKKFRFLVEQLSKVNPSCMDRDQRLAFWINLYNALIMHAYLAYGVPRNDIKLFSLMQKACYTVGGQSFSAAEIEFVILKMKTPVHRPQLSLMLTLNKFKITEDHKKYSIDEFEPLLLFGLSCGMFSSPAVRIFSAANVRQELQESLRDYIQATVGTNGKGKLLIPKLVQSYAKGAVEDSLLADWICHHLAPDQATVIRDSSSQWKQRLLGARSFTVLAFDSKFRYLFLPDSCGSQSQKPEAKQSYKLPEPCSESE

SEQ ID NO: 427 - protein, 597 aa, Zea Mays
MRQYRSQLEQEVKKLQRQLEEEVDLHVALADAVTQNVAPILKSSMKLPHKAQELLINIASLEITVSNLEKKLNDLYYQLCHERNERLLAENNQGCLPSTSSDEHQSLSTCTCTWEEHISSLRDLKFGGSESMRSMRQDLFPELEDDQDMGEDPEGQQIVSLNRLLEKHRDSSLNRLLEKHRDEEMQESGSMENEGNENEQPDTLSFEQSILKITSIKGGNLWSNPNELSEEMVRCMRNIFLRLSESLKISPKTSSDCSSSSVERLSGSTLASFSDSSIMPSMLRSPSVDSNHNDETMKEVRNFDPYKVNGKETRRDIGNYRSAAEVSWMSVGKDQLEYASEALKKFRFLVEQLSKVNPSCMDRDQRLAFWINLYNALIMHAYLAYGVPRNDIKLFSLMQKACYTVGGQSFSAAEIEFVILKMKTPVHRPQLSLMLTLNKFKITEDHKKYSIDEFEPLLLFGLSCGMFSSPAVRIFSAANVRQELQESLRDYIQATVGTNGKGKLLIPKLVQSYAKGAVEDSLLADWICHHLAPDQATVIRDSSSQWKQRLLGARSFTVLAFDSKFRYLFLPDSCGSQSQKPEAKQSYKLPEPCSESE

SEQ ID NO: 428 - protein, 590 aa, Zea Mays
MEVARTFHPRGAHRFLWASCGQQIHRPQACKLVVSWFLSVELALEFACTVLSCVAAPGKVLVPSFGQRQSARQINLVVSHPNTSGDKDVTSDNKSQHGSSELPPRAELIGPTSFAPLIYAAIYVVENSNWQYHVLVIIADGQVFVQHSERSFHTSDVTSKNNQWEMYSETVPKYRDTKVRTKEPLEQYNQTKDDTDYLWYTTSFRLESDDLPFRNDIRPVLQVKSSAHAMMGFANDAFVGCARRNKQVKGFMFEKPVDLKVGVNHVVLLSSTMGMKDSGGELAEVKGGIQECLIQGLNTGTLDLQVNGWGHKAALEGEYKEIYSEKVWAKFSGNRPRTTGQPLGIRSHTELLLELLLKECKSVELTLLRQVVYCSWPTSLTTKGLFICHRGICGAGVERVFADKAVPSWREQLTLRAFVINALLAVMFSVIVMKLNLTTGIIPSLNVSVGLLGFFFVCMWTAAAERMGFLRQPFTRQENTVIQTCVVSAYDISFSGGFGSYLFGMSEKIAKQATTVAHIFELPEEKLCLSFLSNNNTGEDETVIFRGDKHYVASRSVSIIWGYRGECDRYYPCLINDDNGDGHDIWSILY

SEQ ID NO: 429 - protein, 1198 aa, Zea Mays
MMLSDPKDCTLCKGREIIIGEHVTNMMQIFSLKLAKIDVDGGPIELYGYIATRDVLEPLLNYIVNVSRNDPITIEQGSLIEMTGPKRGIELCGEIMLEFDMRIKRGGEEKDDPQLIDGVAIVLDEMSMPRSTYAFTKRIHGDCGAVDITVSRLDFAVEATIQLHGILIAVMTIRNIGVASKRPVMDGPANSREAANQLWQMRREKKRVWMCAHSSHAEAMQQQQRVHPSHDNDKHNNDGFLKPLLGLALALLLSAFLPPTSSCSEQERSALLQFLAGLSRDGGLASSWRNGTGCCAWEGVGCGADGAVTDVSLASRGLEGQISASLGELTALLRLNLSHNLLSGGLPAELTSSNSILVLDVSFNRLNGGLRELPSSTPPRPLQVLNISTNLFTGPFPSTTWEAMTSLVALNASNNSFTGQIPSHICSSSPALAVIEVCYNQLSGLVPPGLGNCSMLRVLKAGHNALSGSLPDELFNATSLEYLSFPGNGLHGMLDSEHIMKLRNLAHLDLGGNRLSGNIPDSIGQLERLEELHLNNNDMSGELPSTLSNCTNLITIDLKVNNFGGELQKVDFFSLPNLKTLDLLYNSFSGTVPESIYSCSKLNALRLSNNNLHGQLSPAIANLKHLVFLSLVSNSFTNITNTLQILKNCRNLTSLLIGSNFKGEDMPEDETIDGFQNLQVLSMSNCSLSGKIPLWLSKLKNLQVLLLHTNQLSGTIPAWIKSLESLFHLDISSNKLTGEIPTALMEMPMLTTEKTATHLDPRVFELPVYKNPSLQYRITSALPKLLKLGYNNLTGAIPQEIGQLKSLAVLNFSSNNLSGKIPLELCNLTNLQVLDLSNNHLRGAIPSALNNLHFLSALNISYNNLEGPIPTGGQFSTFSNNSFEEQSLVIVPRGEGGENKLKFADIVKATNNFHQGNIIGCGGYGLVYKAILPDGTKLAIKKLNGEMLTMEREFKAEVEALSMAQHENLVPLWGYYIQGDSRLLVYSYMENGSLDDWLHTMDDDASTFLSWPMRLKIAQGASQGLSYIHDVCKPHIVHRDIKSSNILLDKDFKAYVADFGLSRLVLANKTHVTTELVGTLGYIPPEYGQGWVATLRGDIYSFGVVLLELLTGRRPVSALFLSKELVKWVQEMKSEGKQIEVLDPHLRGLGHDEQMLKVLEIACKCVDHDACMRPTILEVASCLDTIEPTLRMQNSVRI

SEQ ID NO: 430 - protein, 207 aa, Zea Mays
MVSLKLQKRLAASYLKCGKGKVWLDPNEVSEISMANSRQNIRKLVKDGFIIKKPHKIHSRSRARRAHDAKQKGRHSGYGKRRGTREARLPTKVLWMRRMRVLRRLLRKYREAKKIDKHMYHDMYMKVKGNAFKNKRVLMESIHKSKAEKAREKTLSDQFEAKRAKSKASRERKIARREERLAQGPREITPPVSSTAPATGAPKKAKK

SEQ ID NO: 431 - protein, 184 aa, Zea Mays
MVSLKLQKRLAASYLKCGKGKVWLDPNEVSEISMANSRQNIRKLVKDGFIIKKPHKIHSRSRARRAHDAKQKGRHSGYGKRRGTREARLPTKVLWMRRMRVLRRLLRKYREAKKIDKHMYHDMYMKVKGNAFKNKRVLMESIHKSKAEKAREKTLSDQFEAKRAKSKASRERKIARREERLAQV

SEQ ID NO: 432 - protein, 93 aa, Zea Mays
MVSLKLQKRLAASYLKCGKGKVWLDPNEVSEISMANSRQNIRKLVKDGFIIKKPHKIHSRSRARRAHDAKQKGRHSGYGMLLQLIYVTVLKGE

SEQ ID NO: 433 - protein, 69 aa, Zea Mays
MVSLKLQKRLAASYLKCGKGKVWLDPNEVSEISMANSRKYYPLLGSAWFVICLTSALIFAILVWVCVQL

SEQ ID NO: 434 - protein, 95 aa, Zea Mays
MPMQTKRTKKAGIVGKYGTRYGASLRKQIKKMEVSQHSKYFCEFCGKFAVKRKAVGIWGCKDCGKVKAGGAYTMNTASAVTVRSTIRRLREQTEA

SEQ ID NO: 435 - protein, 92 aa, Zea Mays
MTKRTKKAGIVGKYGTRYGASLRKQIKKMEVSQHSKYFCEFCGKFAVKRKAVGIWGCKDCGKVKAGGAYTMNTASAVTVRSTIRRLREQTEA

SEQ ID NO: 436 - protein, 95 aa, Zea Mays; identical to SEQ ID NO: 434

SEQ ID NO: 437 - protein, 238 aa, Zea Mays
MANWAYDMGKQADPSMGVRSPFKWVAVRVLPISRRPGQRRPLPPSRRAEAFCGRTSELLRGRAARWRAAQAGRAQAASCRGGLPPRRKLQRRATTAPRAAQAERAHAASCRGGPPPRRTLLRPQRRASHHGPCRGHVALEIGRSRAVAVTAAQGRARRVRAARSEGRARPHIREDDEAGSASARGRRRRMVLRSQTTIPAHVAVGKGGARADGPLCCRLGSRAPAVRPFPMGRRRESE

SEQ ID NO: 438 - protein, 393 aa, Zea Mays
MAKTARQHANSPHVCTRDVSITQTDLAASTSNSICINTDIDEFIYEDNDAAKGEINELDVYMKDKPIRWVDPTDRNDKVPSIVEEFMADENEYSSTIEEDRRRPRQAEAAGRPTDRPWDVDVVTRSGKSRLNRPTRRPGRGGPRCFSLRGAVPTKQEQPRAGLREERKRKATRGGAGRGRAKPNAESPRRRTRQGREGGRKRRRSGMRRARPPPVPVPMTPGDAGPEVKYRGVRRRPSGRYAAEIRDPARKTPIWLGTFESAEAAAHAYDAAARTIRGAAARTNFPSASISATVAPPAAPAATSSHSSTVESWSGGSGGGAPVGILRAPAAEEDCRSYCGSSSSALCEDGASGPGCGDETAAPPRCSPLPFDLNVPDPAADEMDWRCDTLLHL

SEQ ID NO: 439 - protein, 347 aa, Zea Mays
MGSLPAPASAEFAPRPRGRATVVASDLAPLFSAQRRHLDHFFDRLDMAQAAAFAQALLDAPGAVFFTGVGKSGIVARKTAQTLASLGLARAGFLAPVDALHGDIGALFPGDVLVILSKSGASDELLALAPCARAKGAYLVSLTSAASGDDCPLAAACDLNVHLPLQGEVCPFGLAPVTSTAIQMVFGDTVIAAIMEARRLSRDQYASNHPAGKIGKTLIFKVKDVMKKQNELPLCKEGDMIMDQLTELTSKGCGCLLVVDEEHHLIGTFTDGDLRRTLKASGPAIFSLTVGEMCNRNPRTITAEAMAVEAMEKMEAPPSPVQFLPVVNENNVVCGIITLHGLVSAGL

SEQ ID NO: 440 - protein, 323 aa, Zea Mays
MKAMAGPKLLVVHASSNKALNGMAPTSPASPGWSRCLWLVVFLALFTCVSLLTVLSTARASAGAPACQAASLTASAAGATEAGLPRHVFDALVQYAAAAGNLSSSMPEPDVRAIASVLRRRAPCNLLVFGLGAETPLWRALNHGGRTVFLDENPYYVAHLEGKHPGLEAYDVAYATAVRELPDLLDAARAARAAECRPVQNLLFSECRLAINDLPNQLYDVAWDVILVDGPRGFMEGSPGRMSAIYSAAVMARTKGAETEVMVHDYEREVERACGREFLCDENRVTATSTPSLGHFLVRGGAAANREAFCGPPAGAAQKSKPS

SEQ ID NO: 441 - protein, 172 aa, Zea Mays
MTPPMDPPDVEMEMEPAPQPPAPTAVGEGWSMLSRARGLLEEGKPSLALQAVLLAIRSQGGEQALMQTLNRARELYAQRLQASPSVDELASLLAQCAIAEAQSSNTNPPQGPGSDPVNMLNSDEACILAESGRKQIILDAFADGSSFICLKCGGLFSTSRKDEHLAYWCGTA

SEQ ID NO: 442 - protein, 130 aa, Zea Mays
MAPLRNMFPNLVTKEELASAEELAPFRRHVTSLAALDFLVCLRSDAFVMTHGGNFAKLIIGARRYAGHRLKSVKPDKGLMSKSLGDPDMGWASFTEDVVVTHRTRTGLPEPTFPGYDLWENPLTPCMCRA

SEQ ID NO: 443 - protein, 425 aa, Zea Mays
MAQLKAAADEQQEAALHGVASGGGNESNKKARAGLCGLLRERKVVDLARAKRRLVEVPYTATLAHTANALLAARVSAVAVAAPPGHWIGAGGSMILESDPATGAVRKHYIGMVNMLDILAHIAEASDDDEAADLDRRMAVPVSSVIGHSLEGLTLWTLHPSTSVLDCMETFSKGVHRALVPLESSADNVVALELVESAPGYRMLTQMDVVRFLRAHGAELRGVLLRTVRELGAVNDTVFAVSGVTKVIDVIKAMRAASLTAVPVVDAVGSGTETLQYGSGQRAVETFSATDLRDCPVARLQAWLGISVMEFKRKVAEYRASTRLVVPGADATDTGTPVAGYADTPAAAAATDEEQSEQQESALVTCSQESTLGEAIEAATSRHVHRLWVVDEEGLLRGVVSLTDILRAVREAALGEDLELHSIVP

SEQ ID NO: 444 - protein, 110 aa, Zea Mays
MALLLALLLVLLLATGGQADADEPATSQQRAVPAEQAPAPKGYETLREEPAPTGGHRHREIKIGACFPISDGGSSAFSCYQRCTSKGYAGGRCDTLPSGFPGDCFCITYA

SEQ ID NO: 445 - protein, 340 aa, Zea Mays
MTFRRSIETISRYFREVLYVVGELRNEMILPPSTATPTKIRDSHRWYPYFKLWLTWCLGLLARGLGLLFGGVPQCLGTGVKTDKGFKEIHLNSVAKNVSEFCGQEVTGQQVYNHLRKWRSRWVKVFKLKDISSALWDEDTFVISLEEGHYVAYIKDHPKDVDYLNRPIENYMPMQIIFGSGVATGRFAMGSNEPLGKPSDIVDILDDGIEVTSEFVDASNLTGKGKTVDKGTPGDSIDTKPMSNLGKRKRYMTDEDVVVFNGMKEAVSDVAAVVRESIHAEAAPGIYNVVINCHGFSREALMYALNHMMEHKATSLVFLDMTPDDRDLWLKTFLTKHYHN

SEQ ID NO: 446 - protein, 131 aa, Zea Mays
MRGRASHLRALLSRALSPSLPPPGRALPQVTRPGASPFGAGFVGRARFFSIDASAATQGGSKPPAPPPAGTAGGEGGGGGQSGKSEQADAGKAVRGGPVSWLSFLLLLVTGGGIIVYYDKEKKRHIEGRLL

SEQ ID NO: 447 - protein, 307 aa, Zea Mays
MRGRASHLRALLSRALSPSLPPPGRALPQVTRPGASPFGAGFVGRARFFSIDASAATQGGSKPPAPPPAGTAGGEGGGGGQSGKSEQADAGKAVRGGPVSWLSFLLLLVTGGGIIVYYDKEKKRHIEELKNRTSAVKPGQSVGTAAIGGPFKLLNHDGKPVTEKDFLGKWTLLYFGFTHCPDICPDELQKMAAAIDKIKEKAKLDVVPVFITVDPERDTVEQVRDYVKEFHPDLVGLTGTTDEVRQVARAYRVYYMKTEEEGSDYLVDHSIVMYLMDPEMKFVKFYGKNYDTDSLADGIVKEIKEHK

SEQ ID NO: 448 - protein, 202 aa, Zea Mays
MRGRASHLRALLSRALSPSLPPPGRALPQVTRPGASPFGAGFVGRARFFSIDASAATQGGSKPPAPPPAGTAGGEGGGGGQSGKSEQADAGKAVRGGPVSWLSFLLLLVTGGGIIVYYDKEKKRHIEELKNRTSAVKPGQSVGTAAIGGPFKLLNHDGKPVTEKDFLGKWTLLYFGFTHCPDICPDELQKMAAAIDKISKSI

SEQ ID NO: 449 - protein, 67 aa, Zea Mays
MKVHAAVKRLCRFCKVVKRRGIVFAKCTANAKHKQRQGFSTIAEAAAVSCVHLPPPPPQLSQTSKQF

SEQ ID NO: 450 - protein, 1373 aa, Zea Mays
MSMDGPATSPASEVPFRISFSGHSGHLRLDPTPHTPSPIPDFVLPPAYPAESPSSVKEYLERNYLDPELHLPTAADSGRVWDVDWFALARPPLEPSAPRTMLAPVWVPPFRRGQEKLQSAAESRVWDPESVQMEMVDVFDSGTGGIAPRMPGPAKDFVRGSINNRPFRPGGLQDDAAEAAALEKAFPEGARTGDWVRELMSGGPAQVAPPGFRKGLELGQLKGYESHWKCFRDGELVEEQPASSSNDTMEKYSVQFDDLFKIAWEEDTANKLLKDGVVQQSAEGEGINEIGEQKVDALQDEFESITTLDDEKQEVDVIRNVPETQTDLDQMLSSEVQDTGREPGASGDKKPTQDGMVWALVGGDEDIVTNFSKLVPDMAIEFPFELDKFQKEAIYYLEKGESVFVAAHTSAGKTVVAEYAFALATKHCTRSVYTAPIKTISNQKYRDFSGKFDVGLLTGDVSIRPEATCLIMTTEILRSMLYRGADIIRDIEWVIFDEVHYVNDAERGVVWEEVIIMLPKHINIVLLSATVPNTVEFADWIGRTKQKKIRVTSTNKRPVPLEHCLFYSGEVYKICERDMFLAQGFKEAKDAFKKKNLNKFGVKPGSKSGTPAVRAGTQGKNPDTSNKGRDQKYPKHRNSNSGVATVQQSSSGPKRFESLFWMPLVNNLLKKSLVPVVIFCFSKNRCDKSADSMFGTDLTSSSEKSEIRVFCDKAFSRLKGSDRNLPQVVGIQSLLRRGIGVHHAGLLPIVKEVVEMLFCRGVIKVLFSTETFAMGVNAPARTVVFDSLRKFDGKEHRKLLPGEYIQMAGRAGRRGLDNIGTVIIMCRDEIPEESDLKNLIVGKPTRLESQFRLTYTMILHLLRVEELKVEDMLKRSFAEFHAQKNLPEKEKLLLQMLRQPTRTIECIKGEPSIEEYYEMTLDAEAHREYITEAIMQLPNSQQFLTPGRLVVVKSDSDDDHLLGVILKNPSALLKKYVVLVLTGDCSSSALAPEFNKNEKGPVDFQGGQFIVLKGKRGMDDEYFSSVSSRKASGVININLPYKGDASGMGFEVRAIENKEIISICSSKIKIDQVRLLEEPNKTAYSRTVQQLIKEQPDGTKYPPALDAIKDLKMKDMYLVESYRAYHILLQKMSENKCHGCIKLKEHISLMREQKMYKDQLNELKFQMSDEALQQMPEFQGRIDVLKVIHYIDSDLVVQLKGRVACEMNSGEELISTECLFENQLDDLEPEEAVAIMSAFVFQQRNASEPSLTPKLAEAKKRLYDTAIKLGKLQSEFKVPVDPEEYARDNLKFGLVEVVYEWAKGTPFADICELTDVSEGIIVRTIVRLDETCREFRNAASIMGNSALFKKMEVASNAIKRDIVFAASLYVTGI

SEQ ID NO: 451 - protein, 443 aa, Zea Mays
MANPRVFFDMTIGGASAGRIVMELYANEVPKTVENFRALCMSWRRPARRLLGQTVMGDGADEEEAQNMCHRTLPKPYLRISMANPCVFFDMTIGGAPAGRIMMELYANEVPKTVENFCALCTSWRRPARRASRSVVMGDCADEEEAHNRCRRGRDRRQVEGGRPHAYQDEELPGLAGYAWGPRILGLGGGFPLRIWWRPWKTGGRLQGHEELDGASLREHEEFTKVKNITKVELGRYEIDTPYMLTRLYSHISTILYSQSKVAEGPNVDIGKSCANGCAEMMENNREHRIALVAAGLAAGIASACWTGPRCVLPMINQSITNSNHTNQLNIQRASRSVFKGWSEEKIYFAPTYKYSCNSYSYAGETATSKKKRRTPAWCDRILWHGDGIAQLSYFRGESQFSYHRPVCGTFTVEVKRLDGRSKRRPSNTNIIIDAVVTDKRQA

SEQ ID NO: 452 - protein, 422 aa, Zea Mays
MANPRVFFDMTIGGASAGRIVMELYANEVPKTVENFRALCMSWRRPARRLLGQTVMGDGADEEEAQNMCHRTLPKPYLRISMANPCVFFDMTIGGAPAGRIMMELYANEVPKTVENFCALCTSWRRPARRASRSVVMGDCADEEEAHNRCRRGRDRRQVEGGRPHAYQDEELPGLAGYAWGPRILGLGGGFPLRIWWRPWKTGGRLQGHEELDGASLREHEEFTKVKNITKVELGRYEIDTPYMLTRLYSHISTILYSQSKVAEGPNVDIGKSCANGCAEMMENNREHRIALVAAGLAAGIASACWTGPRCVLPMINQSITNSNHTNQLNIQRASRSVFKGWSEEKIYFAPTYKYSCNSYSYAGETATSKKKRRTPAWCDRILWHGDGIAQLSYFRGESQFSYHRPVCGTFTVEALQQSMGP

SEQ ID NO: 453 - protein, 496 aa, Zea Mays
MAGRGEKRRRTGGAHEEPEEEDRISDLPDVLRLQILSLLPLKSAIRTGALSSRWRRLWAYRWPEPSSVSIRLPPGGGAAAAAATAAALAVIDRRGRRRVDGFSLAFHGGQLAQADLKRCVDYAAACEAEDLHLRVDGGAGAGGRGSRGGTRRPGMLTLQFPMGSPLLVRLSVRGLNLTAVNNAMVATLEVVHLHSVFLTDAALRRMVAACPRLRDLDLRYCRRLRRVDFTNVGVPNLRSFTVVDCSRTTELRVPVAPRLRSFRFSGAFLSSNILSGAKASLEHLYLCSGGPETGLPVTNLPYAVPRLSNLTVLTLCSIALQYVSSFTAKDVMESNLHGLRELHLLMFGMANSNLADIYSFLKTCPCPQLERLFVQLPTNTGDAFTENFLKVEEEDPPKGGLENLRLAKLTNFKGHRNEMQLVAFLLRQSSSLKKLFLIAPKEDHPQGLRKVHSDMLPDFLKKEISHLERASANTQIFFGEPDAQTHPLHSEVFVRF

SEQ ID NO: 454 - protein, 470 aa, Zea Mays
MDERRTILMDRYEIGRQLGQGNFAKVYFARNLTDGQSVAIKMIDKDKITRVGLIVQIKREISIMRLVKHPNVLQLFEVMASKSKIYFVLEYAKGGELFNKVSKAKLSEDAARRYFHQLVNAVDYCHSRGVYHRDLKPENLLLDENENLRVSDFGLSALSESRRHDGLLHTTCGTPAYVAPEVLGRRGYDGTKADIWSCGVILFVLVAGYLPFHDPNLIEMYRKISRAEYRCPRSFSGELKDLLFRMLDPDPSTRISISRIKRSTWYRKPIEANAAKIKHGTARDTTVRDGEAATASSSIECSNRPEEDQGSSSLPNLNAFDIISLSTGFDLSNLFEERHGRREERFTTRQPVGAVFGRLKELAERLKLKIQKKESGVLKLAAQKEGMKGFLELDAEVFELAPSFLLVELKKASGDTIEYQRLVREEVRPALKDMVWAWQSDRHQQQQQRCEQSVQGEDQQQPLSSLPTQQ

SEQ ID NO: 455 - protein, 858 aa, Zea Mays
MRGLGFVLLLVAAAALIRPSEVVGAEEEDWELFLLQWRQHNSLPSPLLNGDLVDRIWSICLPDMAGAQEILGNPLQFASDQLLSQPSENALKAMLFLEFLSLLSPEKLSSTYGCIHANYFGLGIPQELSVSLATYLESHQLLLGSNFYARRHLADNSIGDAPSMAPDFAPSMSSGDDVKLPQSVTETPYAPSSSYNNENPNRPHHSKPAQKHRGVPPISLLEKHKDYVRLVLIVVLPTAAFSFIAAFLIFYCCGCNKNKVSVGEQRDDHPLLHMQLANVPGSSPDARVSASHLNKDNRSHSGVSMSRCFSCCFKRSTDATPSSEVIGGTPENNVTSDAPKPMSPPAPPPLPPPIKKAPPPPPGPPRGSKARLAQLSPVESSRSEGSSASEQTSESSEAEVNAPRTKLRPFYWDKVLANPDQSMAWHDIKFGSFHVNEDMIEELFGYSGGSRNNLKDKELPSADPASQHISLLNVKKSCNLAVVLKAMNIRVQDIHDALIEGNELPRVLLETILRMKPTDEEEQNLRLYNGDFSQLGLAEQVMKALIDTPFAFKRVDMLLFMSSLQEDASSLRDSFHQLEAACGELKHRLFLKLLEAVLKTGNRLNDGTFRGGANAFKLDTLLKLSDVKGADGKTTLLHFVVQEIVRSEGVREARLAMENGRSPAHSASDDTSNGSLEEDGDHYSNRGLSIVSGLSSEMDNVKRVAALDAEPLFATVVTLRQELLKSREFLNEIATVEETSGFRRSLESFVEHADNETGFLLKEEKRLRSLVKKTIRYFHGNDSKDDGFRLFVVVRDFLVMLDKACKEVGASQKGTNKSRSSGSGSGNGNGNPTFPSILQEQQFPAVIDGHSDSSHTSN

SEQ ID NO: 456 - protein, 533 aa, Zea Mays
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 457 - protein, 153 aa, Zea Mays
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 458 - protein, 502 aa, Zea Mays
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 459 - protein, 366 aa, Zea Mays
MGSRVSGPYMDSPPPPPPRPPSPPRHPPHPQGERHVGGEMLYQDTDHRLRALVGSAEGFGRHAIGGLYGAIHRVTSLQDDGPGSLREACRAEEPLWIVFEVSGTIHLHSYLRVSSYKTIDGRGQRVVLTGKGLRLKSCHHVIICNLVLEGGRGHDVDGIQVKPDSTNIWIDRCTLADYDDGLIDITRQSTDITVSRCHFMRHDKTMLIGADPTHVGDRCIRVTIHHCFFDGTRQRHPRLRFGKVHLYNNYTRSWGIYAVCAGVEAQIVSQCNIYEAGGGPPKKTTVFKYMPEKAGDREDVVAGSISSEGDAFLNGALPCLIDNPGSVFRPEEYYQQWTMEPASPALKDIIQLCAGWQPVPRPPDDR

SEQ ID NO: 460 - protein, 366 aa, Zea Mays; identical to SEQ ID NO: 459

SEQ ID NO: 461 - protein, 366 aa, Zea Mays; identical to SEQ ID NO: 459

SEQ ID NO: 462 - protein, 366 aa, Zea Mays; identical to SEQ ID NO: 459

SEQ ID NO: 463 - protein, 309 aa, Zea Mays
MGSRVSGPYMDSPPPPPPRPPSPPRHPPHPQGERHVGGEMLYQDTDHRLRALVGSAEGFGRHAIGGLYGAIHRVTSLQDDGPGSLREACRAEEPLWIVFEVSGTIHLHSYLRVSSYKTIDGRGQRVVLTGKGLRLKSCHHVIICNLVLEGGRGHDVDGIQVKPDSTNIWIDRCTLADYDDGLIDITRQSTDITVSRSFHSSFPCKSYYYIAKKKTAIRCGNFVVIDILASRLNQPINKLLHADAILCGTTRRCSSVPTPRTSATAASGSPSTTASSTARDRGTPASASERFTSTTTTRAAGASTPSAQA

SEQ ID NO: 464 - protein, 64 aa, Zea Mays
PTPSSRVVRRTRRQPAIPIPILLHANLDDPPLPSFKKESTLHLVLRLRGGNGNADLCEDLDCHV

SEQ ID NO: 465 - protein, 107 aa, Zea Mays
PTPSSRVVRRTRRQPAIPIPILLHANLDDPPLPSFKVRRIGDHPPAFPSPLGIMICYRLWGLLSHRVDLTICYGCSEYSTWELWGACRRRRVGSRRCNDSIGSLRRV

SEQ ID NO: 466 - protein, 586 aa, Zea Mays
MSPAARRILLAVAARRRRFSTDAAASDPSRASQQLPRGKRWDAVVIGGGHNGLVAAAYLARAGRSVAVLERRGVLGGAAVSESDLVPGFRFSRCSYLLSLLRPAILRDLELERHGLKLLPRSPSSFTPCLDGRYLLLGPDAELNYSEISKFSRKDAVAYPRYEEKLENFCKLMDFVIDSAPPELRQEAHFSMVDRMKHRVEKSAFWGHLLRHVMQQGQKNMVEFFDLLLSPASKILNTWFESEVLKATLATDAVIGAMAGVHTPGSGYVLLHHVMGETGGQRGVWAYVQGGMGSVSSAISKAALEAGVQIVTNAEVSQVMVNETSGMVEGVALVDGTEVHSPVVLSNATPYKTFVDLVPSSVLPEDFLCAIKAADYSSATTKINVAVDRLPQFQCCNTNLEGGPEHMGTIHIGSESMEEIDVAYREAADGISSKRPVIEMTIPSVLDKTISPPGQHVINLFVQYTPYKLSEGSWQDSNVRKAFAERCFSLIDEYAPGFSSSVVGYDMLTPPDLEREFGLTGGNIFHGAMGLDSLFLMRPAKGWSDYRTPVKGLYLCGSGAHPGGGVMGAPGRNAAAVVLEDHVKTK

SEQ ID NO: 467 - protein, 180 aa, Zea Mays
MGTIHIGSESMEEIDVAYREAADGISSKRPVIEMTIPSVLDKTISPPGQHVINLFVQYTPYKLSEGSWQDSNVRKAFAERCFSLIDEYAPGFSSSVVGYDMLTPPDLEREFGLTGGNIFHGAMGLDSLFLMRPAKGWSDYRTPVKGLYLCGSGAHPGGGVMGAPGRNAAAVVLEDHVKTK

SEQ ID NO: 468 - protein, 124 aa, Zea Mays
MAQAHVAARFMTEVAPPQVVSVMRQRRKKVPRSLDTIAEDDDREQQLACGPPSDHGFAAAWSLPTPTPTPPQPRERAGGFVARGLVGKYLSDAHDGCQASGWEGGHMLGHRRAVHAQELHEVGA

SEQ ID NO: 469 - protein, 306 aa, Zea Mays
MANSSNYGLGLACFFAIAAAVAGGTQFMVGGANGWSVPTAGAEPFNTWAERTRFQIGDSLVFVYPKDQDSVLLVEPADYNACDTSSYVRKFDDGDTVVTLDRSGPLFFISGVEANCRANEKLIVMVLAARSNGNGTGGGAQAPSTAPQPASPAASPPPASSTPPPPSSPAPKGASPPPASAPTTTPGTPPPPAPSASSPAPASSTPPPPSAPQAPPPPPASSASSPAPALTTPPPPSATANAPQAPPPPSASSPSPSAHGATASSTGTPSSPPAGAEVKNGAALTVATGLASSFGACILGYAMLAL

SEQ ID NO: 470 - protein, 217 aa, Zea Mays
MQAPKELAKPVATVRAAPFLTSAPAGGDDGVPVELAVAPCALGDGELAEGGGGACGAFAVADGGGGVVNAGAGDDALEAGGGGGACGADGGGGVDDAGAGDDALGAGGGGVPGVVVGAEAGGGDAPLGAGDDGGGGVELAGGGDAAGDAGCGAVLGACAPPPGVSDLKPRPLRPSVEGLGAGGGHAPAIGAADHELRPAGDRSSNGEEASKPKAVVA

SEQ ID NO: 471 - protein, 159 aa, Zea Mays
MAIKMKGIFKGLKIISQMFAHKEQEMEIGYPTDVKHVAHIGLGTSDTSPSWMAEFKGTDDSSAGSVSTAAQSRQTSWASADFEQPRSMLPIDIFQDKRPGQENPDVQRGERKARRKKTKKNRASSPPASSARSSSARSTASFATAYDAFSESQRGFPVA

SEQ ID NO: 472 - protein, 424 aa, Zea Mays
MASAVASNVHAGPAAAAMSFGWLGPGLPFGARDAAAEAEEPAAAAKAEPAAICKDLIDFEFSLGGSATMLPADELFADGKLLPLRPQATAGKAEAERERERVLRRDTALVAEATPGPVRALHPAAAEAALDPYVFSPKAPTCSSRWRELLRLRKVQTPHKPTPSPSPSASASPAVTPSRASSSSAARSLKLLLLQRNGGRASDLPAAPLLRDSSDSETSLSLASSRFSLSSSSSSSGHDHDDFPRHSLDSVDLTPRPRIRLVRSHHHQPPQPQPQPHPPAAASAPVRAAHSPARRRQSQSPSPPPPPSVVSVDSPRMNASGKIVFQGLERSSSSPAGSAHSSMRSRSRSRVMDRSYSAGVRATPVVLNVPVCSRPVFGFFKEKKEAAARDAASARARSALGRKTAARTAPPAGVASARDLGSGN

SEQ ID NO: 473 - protein, 149 aa, Zea Mays
MATWQVIVAVVEGTRLAPDTADLEAISSSAATLRLLQTSSSTAATQQTDSTEKTALAVAATAAVDLTNLFFLLRGDTDTDAERRRRWGWTGGICVLFAFAALLSAAGTVLAPHVVSAARRRVLLVASAAALFVASAGTVLVLLLVELDA

SEQ ID NO: 474 - protein, 128 aa, Zea Mays
MSARHKQSRWMVWTRSRFPELDKHSWCRASVGRHTALACSGTAGQPAAGGAARALHFTARGGAGRRTATAVDAAIQAQNAARATGHGTLPPVPTTTTTLTQREAATSSERESGRSRGPIAVANTTKYQ

SEQ ID NO: 475 - protein, 41 aa, Zea Mays
MEAHMVTYQKAPHFQGWKWCTPSNLYVISDHSFNSSDYIKG

SEQ ID NO: 476 - protein, 158 aa, Zea Mays
MGEGAVSLRVSVRTPIGAKGRKKRGKRKYLWEQPRSSASKWVTREGAAPPLVFARMSATTCCQGSTATMKQDVDLALALLFWLRQGSVLLNASNFSIGGVLVGRVFGHGDLGAGERWRLGPPRAPPPRTLYDTTAQGDLGRGRQGVGRGGRGLGFCPA

SEQ ID NO: 477 - protein, 320 aa, Zea Mays
MRPLSSTHHIYLPPLATCSPPLPAQSWDEFRSRPLASAPDPSSHPLLLAGMRRADLVELVFALRGDRQVTERAMEVAGVVASAADSPGAAAARPSRYESQKRRDWHTFGQYLRNHRPPLELARCSGAHVLEFLRYLDQFGKTKVHAARCPFFGHPSPPAPCPCPLKQAWGSLDALVGRLRAAFEEHGGRPEANPFGARAVRLYLREVRDSQAKARGIAYEKKRRKRHPPAHRQPKQQQQQDGQHQHPSHAAPGTVAEPPAPHFLIPHAHFLHGHFLAPATEPIDPAAGGGGGTGDDIALAMAAAAEAHAAGFLMPLSVFN

SEQ ID NO: 478 - protein, 315 aa, Zea Mays
MRPLSSTHHIYLPPLATCSPPLPAQSWDEFRSRPLASAPDPSSHPLLLADLVELVFALRGDRQVTERAMEVAGVVASAADSPGAAAARPSRYESQKRRDWHTFGQYLRNHRPPLELARCSGAHVLEFLRYLDQFGKTKVHAARCPFFGHPSPPAPCPCPLKQAWGSLDALVGRLRAAFEEHGGRPEANPFGARAVRLYLREVRDSQAKARGIAYEKKRRKRHPPAHRQPKQQQQQDGQHQHPSHAAPGTVAEPPAPHFLIPHAHFLHGHFLAPATEPIDPAAGGGGGTGDDIALAMAAAAEAHAAGFLMPLSVFN

SEQ ID NO: 479 - protein, 270 aa, Zea Mays
MRRADLVELVFALRGDRQVTERAMEVAGVVASAADSPGAAAARPSRYESQKRRDWHTFGQYLRNHRPPLELARCSGAHVLEFLRYLDQFGKTKVHAARCPFFGHPSPPAPCPCPLKQAWGSLDALVGRLRAAFEEHGGRPEANPFGARAVRLYLREVRDSQAKARGIAYEKKRRKRHPPAHRQPKQQQQQDGQHQHPSHAAPGTVAEPPAPHFLIPHAHFLHGHFLAPATEPIDPAAGGGGGTGDDIALAMAAAAEAHAAGFLMPLSVFN

SEQ ID NO: 480 - protein, 366 aa, Zea Mays
MRLPPPSTTAAAAAATVGAVLAAVALRRYLSASRHREPARVPMSAAAGATTLVVYGKSAQEQELLASAAGSVVLGEGDPSGDVAIALAYESAGFDAAAYMSALRARRFGRWMLWTPRIGSTQDLITRNFAKLPVGVVCVADVQFKGRGRSKNVWESPPGCLMFSFTSQMQDARKLPLMQYVVCLSITEAIKELCRAKGLPELDVRIKWPNDLYLKGLKVGGILCTSSYEPKVYNICTGVGLNVDNEKPTTCLNAALQEANHTSPILKREDILAYFFNKFENLFEIFMNHGFQVLEEQYYNSWLHSGQRVVVHDAHENKSGSVVTIQGLTPTGYLHAIGEDNKSYELHPDGNSFDFFTGLVRRKMEA

SEQ ID NO: 481 - protein, 807 aa, Zea Mays
MANLAAQLAAVLQACIKRSGGRKPSRSNAKAAHARVLAAGLAADTFLLNRLVELYSLSGLPCHALRAFRALPHPNVYSYNAAISAACRAGDLAAARDLLGRMPDRNAVSWNTVIAAVARSGSPGEALEMYQGMLQEGLAPTNFTLASVLSACGAVAALDDGRRCHGLAVKVGLDGHQFVENGLLGMYTKCGSVADAVRLFDGMPSPNEVSFTAMMGGLAQGGAVDDALRLFARMSRTGIRVDPVAVSSVLGACAQACAGDYNVARAIQLAQSIHALVVRKGFGSDQHVGNSLVDLYAKGMKMDEAIKVFESLSSVSIVSWNILITGYGQLGCYERAMEVLEFMQESGFEPNEVTYSNMLASCIKARDVPSARAMFDKIPKPSVTTWNTLLSGYGQEELHQETIDLFRRMQHQNVQPDRTTLAVILSSCSRLGNFELGKQVHSASVRLLLHNDMFVASGLIDIYSKCGQVGIALIIFNMMTERDVVCWNSMISGLAIHSLSEEAFDFLKQMRENGMFPTESSYASMINLCARLSSIPQGRQMHAQVLKDGYDQNVYVGCSLIDMYAKSGNMDDARLFFNCMIVKNLVAWNEMIHGYAQNGFGEKAVELFEYMLTTKQKPDSVTFIAVLTGCSHSGLVDEAVTFFNSMESNYGITPLVEHYTCLIDALARAARFAEVEAVIGKMPYKDDPILWEVLLAACVVHHNAELGEFSAKHLFRLDPKNPSPYVLLSNIYATLGRHGDASAVRALMSSRGVVKGRGYSWVNHKDGSRAFMVADDLGTDVGERTMFSDNGDTSGMTEVHIDETCAG

SEQ ID NO: 482 - protein, 224 aa, Zea Mays
MASVVVRPSKLLLALLVAAMAASPRALAYDPSPLQDFCVADTASNVFVNGQACKDPAQVTAADFAFSGLQDAGDTGNAFGSKVTLVDARALPGLNSLGVAMARLDIAPGGVNPPHTHPRATEVLTVVEGQMYAGFLATDGKLFARVLNRGDAFVFPRGLVHFEFNCGAGPAVGLAGLSSQNPGLVRVADSLFGAAPAVTDEVLAKAFRIDAATVQRIKAQFAKK

SEQ ID NO: 483 - protein, 55 aa, Zea Mays
MWANCYLQSTMDPGRQMASIRACSATPLAHHTIDPPDPLEHWVEAGLHVWTDRCF

SEQ ID NO: 484 - protein, 444 aa, Zea Mays
MREILHIQGGQCGNQIGAKFWEVICDEHGIDHTGKYAGDSDLQLERINVYYNEAGGGRFVPRAVLMDLEPGTMDSVRSGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPTFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMLNVQNKNSSYFVEWIPNNVKSSVCDIPPTGLAMASTFVGNSTSIQEMFRRVSEQFTAMFRRKAFLHWYTGEGMDEMEFTEAESNMNDLVAEYQQYQDATAEEEEEYKEGDEVAA

SEQ ID NO: 485 - protein, 416 aa, Zea Mays
MEFTLIPNLVPQNRHAVIKGNGISAEIPGNLAEEKGSIIEENEIYEISRFTISSARQMFKPVHIDKMIHFTYHTIIKASLDSPSTFPRYVYHLTPLHQIESYIQKNEYFLDVLGVITQVSALKPVRTQTRESSNVIKEIIIKDINDVTMRLTLWAERAKAFKLDDVYNPLEQKPIVTLFVGCLAKNFQGAYLNGGTTCRWYFNPDIKEAAPYYQRFGSQKVKLQIPSEQEQQLSVAKETHVEHKTLHELLALDPYAFPKQGYECTVTIIEVPTTNRWWFPACTKCSRACRPQDGGYYCSYCKSEAYTLRSQVLDVAQGTNADKGIPTDKGKEIEPHLQSPPKRSQVLDVAQGTNADKGIPTDKGKEIEPHLQSPPKSPDSKKLAVASGVSRSVLFLLVDVAVKAVESEITCFLYSK

SEQ ID NO: 486 - protein, 223 aa, Zea Mays
MALDPAAASAVWGEGVGSGAACLGACAICEARPTWALGAGPTRALRRPPPEASAREQAPARALSAAPEGARRGSRGALSAGTRGRGVAPRVAGGCALEALRPAAGGARAGPTRARCTQGARGSAVRRGMQAWRPQARRDPAMGEAPARRPAWHTWHRSRTAKPVADWSRRVPAQTRAHRPRPIAAPRPGLALDAGSILGALAPLWSLKRAGPAPWWSPGGGCF

SEQ ID NO: 487 - protein, 126 aa, Zea Mays
MKRLLRRLSRTVVAAAASSEDGGAAARPSSKDDGSRRRRRKKAGSVPEGHVPVCVGEEGGPVERFAVRAELLGEPPFAALLRRAAQEYGYAHPGALRIPCPVADFRRLLLRLSRDPAPAAGRYAYA

SEQ ID NO: 488 - protein, 444 aa, Zea Mays
MPPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHMALASDDVLRTLREMQARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 489 - protein, 265 aa, Zea Mays
MEPGSPAPKKSRLVHSADCEMEEAQAPSSSNAAGGVNQSLHWTQWQILDSILPTGGFAHSYGLEAAMQSRVVNDQEDLRSFVVQVLDSAGSLLLPFVHCACAGKSPGDAAAWAKLDRLLDATLTNEVARKASAAQGSALLRVAASVFAEVPALQELRRTLLGSKSVSFHHAPVFGLVCGLVGFDGETAQRAYMFVTMRDVLSAATRLNLIGPLAASVLQHQLAPDAERMVRKWRDRDVSEASQTAPLLDAVQGCHAYMFSRLFCS

SEQ ID NO: 490 - protein, 265 aa, Zea Mays; identical to SEQ ID NO: 489

SEQ ID NO: 491 - protein, 265 aa, Zea Mays; identical to SEQ ID NO: 489

SEQ ID NO: 492 - protein, 265 aa, Zea Mays; identical to SEQ ID NO: 489

SEQ ID NO: 493 - protein, 265 aa, Zea Mays; identical to SEQ ID NO: 489

SEQ ID NO: 494 - protein, 58 aa, Zea Mays
MGVAESAAGGQGEQLDSGPVLCCRRRWKGYSPLRADSGDKASGVRGCAWLQKERRRLY

SEQ ID NO: 495 - protein, 299 aa, Zea Mays
MADMVSGVASQGARPALRWSATMSGFVLRRFVDLIGTGVRTDKGFKEIHLNSVAKNVSEFCGQEVTGQQVYNHLRKWRSRWVKVCKLKDISGALWDEDTFVISLEEGHYAAYIKDHPKDADYLNRPIENYMAMQIIFGSGVATGRFAMGSNEPLGKPSDIVDILDDGIEVTSEFVDASNLTGKGKTVDKGTPSDSIDTKPMSNLGKRKRYMTDEDVVVFNGMKEVVSDVAAAVRESIHAEAAPGIYNAVINCPGFSREALMYALNHMMEHKATSLVFLDMTPDDRDLWLKTFLAKHYHN

SEQ ID NO: 496 - protein, 994 aa, Zea Mays
MLPPPPPPSSLRDLLSRERVDEDEAPHLSPRRASGRSPPRRGASSRSSRHTSSPPLATTTTTTREAEGEAAAADAVVAVLSAYAGRLLRDAEFRRALRDKCAACLAPAAGAGEDDDAAAGRPVLANLELGIESIERLAADGSAAQPQAPRDAKIRSLRNSIRLLSVVASLHSPPPPPRPGAAAGDGGGRTCGVPNSHLAACAQLYLAVVYKMERNDRVAARHLMQVFADAPGLARRELLPDLWDHVFLPHLLHLKVWFAREADDLVAGRDADDRRTRMKALQRLYSDHMDSGTAQFAVYYKEWLQSGAAAPPPVPSVPLPSTPRSFDGREKSSASVHRTSINRDLYNAVFGTALALGQEDVKDTKLDDGTGLALDLDVELDHDAAGFKTQKLAHSKMGLQEKHSRSRKEGAALAETAPAQRKSYSFRLFSCQGDISRNVISHPKAAKKEPVVSVEKELDSSELAPAVVPLLERAVSVVSSSDSLSQCEDAVHEVARACSAWDPSLVNLLSCASFIQGLLEVTLTSKDDAVLESAMSIMGKLVLGNEVIRQLVLNADPQLEVFLRLLRSSELFLKAAVVLYMMKPKAKQMLSLDWVPLVLHVLECGDEVQSLFSVRCAPKIAAFYFLDQLLMGFDVDRNVENAKQMIALGGLDLLIGRLGAGDARESRHCIALLTTCVQADGSCRHYLADSLKKEPLVQLLAGNQRKASAASLNLMSELVCLNRTSKIVEFVKELKNSGCLNTMHVLLVYLQQAPLVQHPLAATMLLQLDLLGDPSQYSVYREEAIEAIVAALEHSSQSRKVQEQCARALLILAGRFSSSGEPVAEAWLLKRAGLDDSLSESFRRSEVFKDKSVRAEEEKLVEERQKNLALMLLKSGGRRFLTALSSCISDGTPSLSRSCLVSVAWMSSSLSPLRGCNDFQPLACSVLASKLLDSLSYDRVLEERVLASLSLLNVVRHPECMEKVFPLKKETIESLQDLAEVTWTAKELLFACCR

SEQ ID NO: 497 - protein, 442 aa, Zea Mays
MNILLELKHLKLFSMPARPVICKGLLIVIALILLRAIVSPFLAIDSSEKKEFYESTAPDLLPRIRRDKFLEVPQIIWGLNNQKIAFARACLTARFLNRSLLMPSLSASLFYKEVDLLQPVSFDKVFDFNKFNARCHGFVRLAQYSEVSNRTEPFKLQKGTGRRWTADRDLDQLQQSIGSNVDDSEVIEIVGKNPFLWPDHWPVKDYAKIFDCLVLVPEIETEVVKVISKIREAGQRARHEAGGSHSKQRRDSSTNPPVPYVAVHMRIEKDWMIHCKKWEQRSKSHEICSSKEEIIHKVSQITDLRRPVVVYLAVADSLLEDDSITSGWRVGMVAYEKKKLGVTDIYDRQPYLIKSAIDFEVCSRADVFVGNSFSTFSNLVVLSRTERLYNLGKASSCGENIGLSSYAYNVMGDDGGPQRWMTDMSDTSLQRLSYGTNNVSCH

SEQ ID NO: 498 - protein, 130 aa, Zea Mays
MLPRSLKLALRKSLRARARSTAIYDAFLAHDWRETLEKTTLAWLAPMAHNTVRWQAERSFEFEQQQQRVVSERSVLLLQTLYFADREKTEAAVCELLVGLNYICRYERQQNALLDCSSSDFDDCVEWQVQ

SEQ ID NO: 499 - protein, 169 aa, Zea Mays
MTEQQEGVSKSSSSSISSSTQESEEELTIGTLITEATNTTNSAKSLGKRLSHLDSIPHTPRVNGKIPDFNNATIDHESLLERLGTYGLAEYQIEGDGNCQFRALADQIFRNPDYHKHVRKAVVKQLKEFRKHYEGYVPMEYKVYLKKMKRSGEWGDHVTLQAAADRSFG

SEQ ID NO: 500 - protein, 197 aa, Zea Mays
MTEQQEGVSKSSSSSISSSTQESEEELTIGTLITEATNTTNSAKSLGKRLSHLDSIPHTPRVNGKIPDFNNATIDHESLLERLGTYGLAEYQIEGDGNCQFRALADQIFRNPDYHKHVRKAVVKQLKEFRKHYEGYVPMEYKVYLKKMKRSGEWGDHVTLQAAADRFAAKICLLTSFRDTCLVEIVPRDATPTREFC

SEQ ID NO: 501 - protein, 227 aa, Zea Mays
MTEQQEGVSKSSSSSISSSTQESEEELTIGTLITEATNTTNSAKSLGKRLSHLDSIPHTPRVNGKIPDFNNATIDHESLLERLGTYGLAEYQIEGDGNCQFRALADQIFRNPDYHKHVRKAVVKQLKEFRKHYEGYVPMEYKVYLKKMKRSGEWGDHVTLQAAADRFAAKICLLTSFRDTCLVEIVPRDATPTRELWLSFWCEVHYNSLYAVEDLPTRKTKKKHWLF

SEQ ID NO: 502 - protein, 89 aa, Zea Mays
MEYKVYLKKMKRSGEWGDHVTLQAAADRFAAKICLLTSFRDTCLVEIVPRDATPTRELWLSFWCEVHYNSLYAVEDLPTRKTKKKHWLF

SEQ ID NO: 503 - protein, 101 aa, Zea Mays
MTEQQEGVSKSSSSSISSSTQESEEELTIGTLITEATNTTNSAKSLGKRLSHLDSIPHTPRVNGKIPDFNNATIDHESLLERLGTYGLAEYQIEGDGNCQT

SEQ ID NO: 504 - protein, 116 aa, Zea Mays
MTEQQEGVSKSSSSSISSSTQESEEELTIGTLITEATNTTNSAKSLGKRLSHLDSIPHTPRVNGKIPDFNNATIDHESLLERLGTYGLAEYQIEGDGNCQVSFLYHVQNYLFICMK

SEQ ID NO: 505 - protein, 394 aa, Zea Mays
MVSLRCTTAHHSLLGSPTCLARPRRRPCPVVRAAVAVEAGAQAKVSLIRIGTRGSPLALAQAHETREKLKAAHSELAEEGAIEIVIIKTTGDMILDKPLADIGGKGLFTKEIDDALLQGRIDIAVHSMKDVPTYLPEGTILPCNLPREDVRDAFICLTANSLAELPAGSVVGSASLRRQSQILYRYPSLKVVNFRGNVQTRLRKLKEGDVSATLLALAGLRRLKMAENATAVLSVEEMLPAVAQGAIGIACRSNDDKMMEYLSSLNHEDTRLAVTCEREFLAVLDGNCRTPIAAYAYRDKDGNCSFRGLLSSPDGSKVFETARSGPYSFDDMVEMGKDAGHELRRRLGLASSIAFNEQNVRPCAISVGTLSVENEGQSRLLRGLFLFLLFFSYY

SEQ ID NO: 506 - protein, 356 aa, Zea Mays
MVSLRCTTAHHSLLGSPTCLARPRRRPCPVVRAAVAVEAGAQAKVSLIRIGTRGSPLALAQAHETREKLKAAHSELAEEGAIEIVIIKTTGDMILDKPLADIGGKGLFTKEIDDALLQGRIDIAVHSMKDVPTYLPEGTILPCNLPREDVRDAFICLTANSLAELPAGSVVGSASLRRQSQILYRYPSLKVVNFRGNVQTRLRKLKEGDVSATLLALAGLRRLKMAENATAVLSVEEMLPAVAQGAIGIACRSNDDKMMEYLSSLNHEDTRLAVTCEREFLAVLDGNCRTPIAAYAYRDKDGNCSFRGLLSSPDGSKVFETARSGPYSFDDMVEMGKDAGHELKAKAGPGFFDSLQ

SEQ ID NO: 507 - protein, 353 aa, Zea Mays
MHHRAPLPPRLADLPRAPAAAAVPRRARCRRRGGRRSGQGLTHPDWDAWEDSPLALAQAHETREKLKAAHSELAEEGAIEIVIIKTTGDMILDKPLADIGGKGLFTKEIDDALLQGRIDIAVHSMKDVPTYLPEGTILPCNLPREDVRDAFICLTANSLAELPAGSVVGSASLRRQSQILYRYPSLKVVNFRGNVQTRLRKLKEGDVSATLLALAGLRRLKMAENATAVLSVEEMLPAVAQGAIGIACRSNDDKMMEYLSSLNHEDTRLAVTCEREFLAVLDGNCRTPIAAYAYRDKDGNCSFRGLLSSPDGSKVFETARSGPYSFDDMVEMGKDAGHELKAKAGPGFFDSLQ

SEQ ID NO: 508 - protein, 86 aa, Zea Mays
MFMMLLTFSVGYVLEKSRGQNSDAEVSNFTSRAEFQSITYWNHDTAPSAEDSLPRCFHWLTVANAMHRAVTAEDLTNMAAMQNQDK

SEQ ID NO: 509 - protein, 160 aa, Zea Mays
MEPATPPAPAAGVTATVDLSSVAADLGGAHLLPCGIRQNGGAPVSDYFKPRDTGVEVEGVKMEEAFFRGRKLQGTTLALPDGYRGYVLEKSRGQNSDAEVSNFTSRAEFQSITYWNHDTAPSAEDSLPRCFHWLTVANAMHRAVTAEDLTNMAAMQNQDK

SEQ ID NO: 510 - protein, 100 aa, Zea Mays
MEPATPPAPAAGVTATVDLSSVAADLGGAHLLPCGIRQNGGAPVSDYFKPRDTGVEVEGVKMEEAFFRGRKLQGTTLALPDGYRGYITFFLLPSSSLQDF

SEQ ID NO: 511 - protein, 152 aa, Zea Mays
MVGSNSSVHGSELHQIADSLVAAMERMLNERLSTIGGRRLHHCDPEELNHEESGDENSGFSHEFDPFGDGRRGYGDGRHTNFDNLCGRRHAHGHRVRFEDEEFEDRDREASDENPFANDGMFGWHHHHQHANFEDSESYHGHRHRNDPNNIA

SEQ ID NO: 512 - protein, 217 aa, Zea Mays
MAATHAFYLFYLLVRPLLGYLSSRIYVCLSSWGLITVCYNNLSIPMLCPVDVDLGTIGLSHQRNLLMILHNVLGQEILNWLWHEEGTINISWGPASYREFICKCVVINVEHRSMRRAPLASVGNLPPMGRCECDITLKLPNQSLHRSRHQHEEGTISISWERTCILWGKHEEGTIIIIDSNLPPYGESPLPTSAWMFIAGPHDLSTLFWVRSPKKWL

SEQ ID NO: 513 - protein, 75 aa, Zea Mays
MEPATPPAPAAGVTATIDLSLVAADLGGAHLLPCGIRQNGGAPVSDYFKPRATGPDGYRGDITFFLLPSSSLQDF

SEQ ID NO: 514 - protein, 65 aa, Zea Mays
MQQHLPPSLLVRRKPLTHREEQQPTLQNTKQRQQPPWRPCFHPIVERPCCSLQCPLDVRRNTREK

SEQ ID NO: 515 - protein, 388 aa, Zea Mays
MATPTAPSHLPLATASASTSFPDRFLRTPCALRPRSWPRLRAGSVKEWREFEDDAGAVKEWREFEDAVRRKDLPRALQFLQSVEPAAVQVAVPVPPGRDWEVLDACVDADDMRLVGRAYQFLVDRGVLASFGKCKNIVLEWPREVTPTVLKEMTGLEAEKLAPKKWGLSGSSPYVLIGFLGGVSFLLTQGVDLRPKLSAVLGLAAADAMLLGGTCLAQISCFWPPYKRRILVHEAGHLLTAYLMGCPIRGVILDPFVALRMGIQGQAGTQFWDEKMEKELAEGHLSSTAFDRYCMIMFAGIAAEALVYGEAEGGENDENLFRSLCILLNPPPAVAQMANRARWSVMQSYNLLKWHKKAHRAAVKALEDGHSLSVVIRRIEEAIASDSK

SEQ ID NO: 516 - protein, 146 aa, Zea Mays
MTTSLKKNRKKRGHVSAGHGRIGKHRKHPGGRGNAGGMHHHRILFDKYHPGYFGKVGMRYFHRLRNKFHCPSVNVERLWSMVPAGKAAEAAGADQAPLVDVTQFGYFKVLGKGMLPSRPIVVKAKLISKVAEKKIKAAGGAVLLTA

SEQ ID NO: 517 - protein, 186 aa, Zea Mays
MATKRSVGTLGEADLKGKKVFVRADLNVPLDDAQKITDDTRIRASVPTIKFLLEKGAKVILASHLGRPKGVTPKYSLKPLVPRLSELLGVEVVMANDCIGEEVEKLAAALPEGGVLLLENVRFYKEEEKNEPEFAKKLASVADLYVNDAFGTAHRAHASTEGVTKYLKPAVAGFLMQKVIKCHPCS

SEQ ID NO: 518 - protein, 572 aa, Zea Mays
MVEAAGAEATRRDRGRSIAGHLHLAVAFPTHRFPFQNLPTLPFQNHRIRAVHYQSAGPGNPQAPLLPPSQATPFPRRHQVPPSAAPACQAHKQPHTARVAASGCLSIKKNRPSIRSPHPKHIPSHPIPLPPISSSADSIRFFQPRVSLRIRRRLVSRVSGAAAAAACRAVMATKRSVGTLGEADLKGKKVFVRADLNVPLDDAQKITDDTRIRASVPTIKFLLEKGAKVILASHLGRPKGVTPKYSLKPLVPRLSELLGVEVVMANDCIGEEVEKLAAALPEGGVLLLENVRFYKEEEKNEPEFAKKLASVADLYVNDAFGTAHRAHASTEGVTKYLKPAVAGFLMQKELDYLVGAVANPKKPFAAIVGGSKVSTKIGVIESLLAKVDILILGGGMIYTFYKAQGYSVGKSLVEEDKLELATSLIEKAKAKGVSLLLPTDIVVADKFAADAESKIVPATAIPDDWMGLDVGPDATKTFDEALDTTKTVIWNGPMGVFEFQKFAAGTEAIAKKLAELTTTKGVTTIIGGGDSVAAVEKAGLADKMSHISTGGGASLELLEGKTLPGVLALDDA

SEQ ID NO: 519 - protein, 402 aa, Zea Mays
MATKRSVGTLGEADLKGKKVFVRADLNVPLDDAQKITDDTRIRASVPTIKFLLEKGAKVILASHLGRPKGVTPKYSLKPLVPRLSELLGVEVVMANDCIGEEVEKLAAALPEGGVLLLENVRFYKEEEKNEPEFAKKLASVADLYVNDAFGTAHRAHASTEGVTKYLKPAVAGFLMQKELDYLVGAVANPKKPFAAIVGGSKVSTKIGVIESLLAKVDILILGGGMIYTFYKAQGYSVGKSLVEEDKLELATSLIEKAKAKGVSLLLPTDIVVADKFAADAESKIVPATAIPDDWMGLDVGPDATKTFDEALDTTKTVIWNGPMGVFEFQKFAAGTEAIAKKLAELTTTKGVTTIIGGGDSVAAVEKAGLADKMSHISTGGGASLELLEGKTLPGVLALDDA

SEQ ID NO: 520 - protein, 402 aa, Zea Mays; identical to SEQ ID NO: 519

SEQ ID NO: 521 - protein, 402 aa, Zea Mays; identical to SEQ ID NO: 519

SEQ ID NO: 522 - protein, 597 aa, Zea Mays
MLSVEAHTYYYYPTARPRRKLCACRNVLQETAPRDAEADPCRHGERKSRRRGDGAYYIDKDGGGVARTFDRKKISRKRGGAIKGRGWKYGSGFVDGVFPVLSPMAQDVLELVQTRGTDAASVWESLDKIPQAHDLWDDIVNVAVQLRLNRQWEPIITVCEWVLRRSSFRPDIICYNLLIDAYGQKRQLSEAEAAYMALLEARCVPTEDTYALLLRAYCGSGQLHRAEGVISEMQRNGIPPTATVYNAYLDGLLKARCSEKAVEVYQRMKKERCRTNTETYTLMINVYGKANQPMSSLRVFREMKSVGCKPNICTYTALVNAFAREGLCEKAEEVFEEMQQAGHEPDVYAYNALMEAYSRAGLPQGASEIFSLMEHMGCEPDRASYNILVDAFGRAGLHQEAEAAFQELKQQGMRPTMKSHMLLLSAHARSGNVARCEEVMAQLHKSGLRPDTFALNAMLNAYGRAGRLDDMERLFAAMERGDGAIAGAPDTSTYNVMVNAYGRAGYLDRMEAAFRSLAARGLAADVVTWTSRIGAYARKKEYGQCLRVFEEMVDAGCYPDAGTAKVLLAACSDERQVEQVKAIVRSMHKDAKTLFAL

SEQ ID NO: 523 - protein, 132 aa, Zea Mays
IPTVSFVNSEAQRHQLAPFWQPRRDKRKAKRGHQLTAERKRRRATNPSPRPPPSPRTMAMAAASSRLFWASRAAAYLRISTFPRAFATVLKDLKYADTHEWVKVEGDSATVGITDHAQVNTLTYFYCCEFRV

SEQ ID NO: 524 - protein, 159 aa, Zea Mays
MAMAAASSRLFWASRAAAYLRISTFPRAFATVLKDLKYADTHEWVKVEGDSATVGITDHAQDHLGDVVFVELPEVGISVSQGKNFGAVESVKATSDINSPVSGEVVEVNEKLSEEPGLVNASPYEKGWIIKVKLSNSGDLNSLMDDDKYSKFCEEEDNH

SEQ ID NO: 525 - protein, 157 aa, Zea Mays
MGGGEGKSKKRRSSTSSADEEGGERKRRDKKESKRRSRDDREDDDDRHKKKGKHIDRNKGKERDSKDRHSKEKTSKRKDKDAAFKEISKDDYFAKNNEFATWLKEEKGKYFSDLSSESARDLFLKFVKQWNKGKLPSQYYEGITSGPRSAHNWNIKA

SEQ ID NO: 526 - DNA, 280 bp, Zea mays
  misc_feature (2)..(2): n is a, c, g, or t
  misc_feature (130)..(130): n is a, c, g, or t
tnttaatgattaggaaaaacaagaycgaggatgtggaagaagaaatccaycatctctacaaccgtmtcaataaagaggacaagccrtcyaawtgaaatttttgagaagaaacggcgaacaaaggagagangctcctcaagctagaaaaggttctcatcaagactawagatagcttggagaagatgaccaaagagcatgaggagctagtgtrctctgatgaaaatttggtccaaagttatgaatcagttctaattgagcaagtaaataatgaaaatgttta

SEQ ID NO: 527 - DNA, 24 bp, Artificial
  Synthetic primer sequence
ctcctcatgctctttggtcatctt

SEQ ID NO: 528 - DNA, 16 bp, Artificial
  Synthetic probe sequence
cttgaggagcttctct

SEQ ID NO: 529 - DNA, 22 bp, Artificial
  Synthetic primer sequence
gagaagaaacggcgaacaaagg

SEQ ID NO: 530 - DNA, 15 bp, Artificial
  synthetic probe sequence
ttgaggagcgtctct

SEQ ID NO: 531 - DNA, 101 bp, Zea mays
  misc_feature (51)..(51): n is a, c, g, or t
agattctacaaggaggaagagaagaacgaacctgagtttgctaagaagctngcatctgttgctgacctttatgtcaatgatgcttttggcacggcacacag

SEQ ID NO: 532 - DNA, 16 bp, Artificial
  Synthetic probe sequence
aacagatgctagcttc

SEQ ID NO: 533 - DNA, 25 bp, Artificial
  Synthetic primer sequence
agaagaacgaacctgagtttgctaa

SEQ ID NO: 534 - DNA, 14 bp, Artificial
  Synthetic probe sequence
cagatgcaagcttc

SEQ ID NO: 535 - DNA, 25 bp, Artificial
  Synthetic primer sequence
cgtgccaaaagcatcattgacataa

SEQ ID NO: 536 - DNA, 470 bp, Zea mays
  misc_feature (9)..(10): n is a, c, g, or t
  misc_feature (13)..(13): n is a, c, g, or t
  misc_feature (17)..(17): n is a, c, g, or t
  misc_feature (74)..(74): n is a, c, g, or t
  misc_feature (136)..(139): n is a, c, g, or t
  misc_feature (154)..(154): n is a, c, g, or t
  misc_feature (156)..(158): n is a, c, g, or t
  misc_feature (168)..(168): n is a, c, g, or t
  misc_feature (170)..(187): n is a, c, g, or t
  misc_feature (202)..(202): n is a, c, g, or t
  misc_feature (204)..(204): n is a, c, g, or t
  misc_feature (210)..(210): n is a, c, g, or t
  misc_feature (217)..(217): n is a, c, g, or t
  misc_feature (265)..(265): n is a, c, g, or t
  misc_feature (277)..(277): n is a, c, g, or t
  misc_feature (310)..(310): n is a, c, g, or t
  misc_feature (331)..(331): n is a, c, g, or t
  misc_feature (346)..(346): n is a, c, g, or t
  misc_feature (364)..(364): n is a, c, g, or t
  misc_feature (424)..(424): n is a, c, g, or t
ataaactanncanttantttgaacctaaaataaattactcaattacacctctgctgctagcactctcccaaaanaaataaattatagattgtctaatccacgcattattttgttatgcaaatctgctcgtgtatgnnnntattattgtttcaancnnnaaacggtagntnnnnnnnnnnnnnnnnnntagcgaggatttatngncactgnttggctncaggcatcgctacttggagaggccattaccgggaagggcatccttgcncagctgaacctngagacgggcatccccatctacgaggcggagccnctcctcctgttcttcatcctnttcaccctccttggngccatcggcgctctcggngaccgcggccgcttcgtcgacgaggaggtcaccggcctcgacaaggccgtcatccaaccnggcaagggcttccgcggcgccctcggcctcagcgagggaggtaatt

SEQ ID NO: 537 - DNA, 14 bp, Artificial
  Synthetic probe sequence
ccgtctcgaggttc

SEQ ID NO: 538 - DNA, 14 bp, Artificial
  Synthetic probe sequence
ccgtctccaggttc

SEQ ID NO: 539 - DNA, 18 bp, Artificial
  Synthetic primer sequence
ggctccgcctcgtagatg

SEQ ID NO: 540 - DNA, 17 bp, Artificial
  Synthetic primer sequence
accgggaagggcatcct

SEQ ID NO: 541 - DNA, 101 bp, Zea mays
  misc_feature (51)..(51): n is a, c, g, or t
tagtacccgcctctcgcaccatagccataactgtagccaccacgcctcccncctccatagtagccaccacgcactctgcctcgtccacgtgaccttcctct

SEQ ID NO: 542 - DNA, 16 bp, Artificial
  Synthetic probe sequence
cctcccacctccatag

SEQ ID NO: 543 - DNA, 15 bp, Artificial
  Synthetic probe sequence
ctcccgcctccatag

SEQ ID NO: 544 - DNA, 17 bp, Artificial
  Synthetic primer sequence
agggcgtgggagaggaa

SEQ ID NO: 545 - DNA, 24 bp, Artificial
  Synthetic primer sequence
ctcgcaccatagccataactgtag

SEQ ID NO: 546 - DNA, 284 bp, Zea mays
  misc_feature (136)..(136): n is a, c, g, or t
ccccacctcagcctgcgcaggagctaagattaaggctcgatcgccgtcgctcagaggaacaaccgaagccacaggcacaraaacggacacaracaacgaacacaaacggaacgatcggcgyaggyggygccctgtnccccgcgcacaacccgatacggwacaaaacagcgcatgsggagrgagaggagagggaggaggakggtrggtcrgtttattacacttgcttcgcctccggcgacggcggaggaggggagccgagtcagcgagragaaggggggytcggg

SEQ ID NO: 547 - DNA, 14 bp, Artificial
  Synthetic probe sequence
ccctgtcccccgcg

SEQ ID NO: 548 - DNA, 14 bp, Artificial
  Synthetic probe sequence
ccctgtgccccgcg

SEQ ID NO: 549 - DNA, 24 bp, Artificial
  Synthetic primer sequence
ggaggcgaagcaagtgtaataaac

SEQ ID NO: 550 - DNA, 22 bp, Artificial
  Synthetic primer sequence
caacgaacacaaacggaacgat

SEQ ID NO: 551 - DNA, 101 bp, Zea mays
  misc_feature (51)..(51): n is a, c, g, or t
acgcttgccgcgcttcttcagcatgagcttaaacccaagtcgctcttgacnatctctggtgaattcgacacaaaggccctggacagatccccaaagtttgg

SEQ ID NO: 552 - DNA, 14 bp, Artificial
  Synthetic probe sequence
ctcttgacaatctc

SEQ ID NO: 553 - DNA, 15 bp, Artificial
  Synthetic probe sequence
ctcttgaccatctct

SEQ ID NO: 554 - DNA, 23 bp, Artificial
  Synthetic primer sequence
cagcatgagcttaaacccaagtc

SEQ ID NO: 555 - DNA, 18 bp, Artificial
  Synthetic primer sequence
gcgccaacccaaactttg

SEQ ID NO: 556 - DNA, 97 bp, Zea mays
  misc_feature (47)..(47): n is a, c, g, or t
gtctacatactagtatgctactgacatatccacgtaaccacgttgcngcgccggatgtagatgataccaccgtgctgcagctgccgtggccggagcc

SEQ ID NO: 557 - DNA, 13 bp, Artificial
  Synthetic probe sequence
acgttgcagcgcc

SEQ ID NO: 558 - DNA, 13 bp, Artificial
  Synthetic probe sequence
acgttgcggcgcc

SEQ ID NO: 559 - DNA, 24 bp, Artificial
  Synthetic primer sequence
cagcacggtggtatcatctacatc

SEQ ID NO: 560 - DNA, 19 bp, Artificial
  Synthetic primer sequence
cgctccgatgggtctacat

SEQ ID NO: 561 - DNA, 95 bp, Zea mays
  misc_feature (1)..(2): n is a, c, g, or t
  misc_feature (51)..(51): n is a, c, g, or t
nncgcaccaaggaccagatcacaggtacgctgctcggcggcccaactgccntcgcctcgttgctccgtgatctattctgtttttctgattgttct

SEQ ID NO: 562 - DNA, 14 bp, Artificial
  Synthetic probe sequence
ctgccctcgcctcg

SEQ ID NO: 563 - DNA, 14 bp, Artificial
  Synthetic probe sequence
ctgccatcgcctcg

SEQ ID NO: 564 - DNA, 19 bp, Artificial
  Synthetic primer sequence
acaccgcatgacacgcata

SEQ ID NO: 565 - DNA, 20 bp, Artificial
  Synthetic primer sequence
agatcacaggtacgctgctc

SEQ ID NO: 566 - DNA, 259 bp, Zea mays
  misc_feature (127)..(127): n is a, c, g, or t
cggcgacgaggccccctcgaagaaggcgtagtccacggggaagttcgggtcgatgtagaggcttatgaacgggtagatgttgacggtgaaggcmccgccgttgtcgctcaggaacttcactatggtnagcatcaggtcrtggatgtccgtgcggaagtccccgtcggaaggcttggaggtcgtcgaggagtagacrtcggcgttgagagggcatgtsaccttgacttggttgcccargcckgcttttatgagcgcgcct

SEQ ID NO: 567 - DNA, 15 bp, Artificial
  Synthetic probe sequence
acctgatgctcacca

SEQ ID NO: 568 - DNA, 16 bp, Artificial
  Synthetic probe sequence
acctgatgctgaccat

SEQ ID NO: 569 - DNA, 18 bp, Artificial
  Synthetic primer sequence
cttccgcacggacatcca

SEQ ID NO: 570 - DNA, 20 bp, Artificial
  Synthetic primer sequence
ccctcgaagaaggcgtagtc

SEQ ID NO: 571 - DNA, 87 bp, Zea mays
  misc_feature (37)..(37): n is a, c, g, or t
acagggacagagagatagatatagagagagattagangagcatggcgcaaaattaaaggaggcccaagcgggaggagggggtgatct

SEQ ID NO: 572 - DNA, 13 bp, Artificial
  Synthetic probe sequence
cgccatgctcttc

SEQ ID NO: 573 - DNA, 13 bp, Artificial
  Synthetic probe sequence
cgccatgctcatc

SEQ ID NO: 574 - DNA, 16 bp, Artificial
  Synthetic primer sequence
cccctcctcccgcttg

SEQ ID NO: 575 - DNA, 15 bp, Artificial
  Synthetic primer sequence
cgcgtgggtggcttg

SEQ ID NO: 576 - DNA, 272 bp, Zea mays
  misc_feature (151)..(151): n is a, c, g, or t
ctaggaattgcttagtcgaggttggcactgaagaartaatcgctccagtgatctgcgtgctaccattacgccattgtaagagcaaatggatcatgtgtcgagaaataatattcatgagcaataatctcgaactaggctggaaatgttggangcctcctggtgacatgcgyytggtttgttggcmtcgttgtgtmaaatctgcctttgagccgaaacttgctcatttgtgtacggcagaatagtgagcttttctactctcyggtgatgtgatc

SEQ ID NO: 577 - DNA, 16 bp, Artificial
  Synthetic probe sequence
aatgttggatgcctcc

SEQ ID NO: 578 - DNA, 15 bp, Artificial
  Synthetic probe sequence
atgttggaagcctcc

SEQ ID NO: 579 - DNA, 24 bp, Artificial
  Synthetic primer sequence
gcaataatctcgaactaggctgga

SEQ ID NO: 580 - DNA, 22 bp, Artificial
  Synthetic primer sequence
gtttcggctcaaaggcagattt

SEQ ID NO: 581 - DNA, 418 bp, Zea mays
  misc_feature (240)..(240): n is a, c, g, or t
ttatgtttattatcatacttctttcttatcgatcagtttggtgtgtcttatggatcaataggactggagtgctgaacctgcgaaccaattgccattttggtgcattgagcattggtccggttccatattagcaagttctagtacgaggaatctctgagaagtagcatctcacatgcttttagggcatgtacaaccctaagacggtggttcggttttccaagtggaaaagaatgttaaganactgcatgatataaccctgagcctcttgaccataaatgaagttaagagactatatagaaagagttgtatagagatgggctcttcgcgaagagcccgtctttttttcaattagccccttagagacccatcaagagaccccatattaaatggggttgtacatgcccttacatgacatggt

SEQ ID NO: 582 - DNA, 50 bp, Artificial
  Synthetic probe sequence
caaccctaagacggtggttcggttttccaagtggaaaagaatgttaagac

SEQ ID NO: 583 - DNA, 50 bp, Artificial
  Synthetic probe sequence
caaccctaagacggtggttcggttttccaagtggaaaagaatgttaagag

SEQ ID NO: 584 - DNA, 301 bp, Zea mays
  misc_feature (151)..(151): n is a, c, g, or t
cgcacggaggcagggagcaccaaaatccaaagggtttgagagaygacgagaggcgacamaagagtgcaacggagagatygagagygagaggcaagccaygascgragagtgggaggagtggcgttagggttagcmtgttagggttatacgntaggtgaggtgtccgtgtatctttgtgggatgggccatgacactgggggagtgggggtaaggggctgrgccgtctctttgtgtagcaggtygataacaaggcyykgcyratascragtcktgcycgggcyrgcccaayrggctcaaayrg

SEQ ID NO: 585 - DNA, 20 bp, Artificial
  Synthetic probe sequence
ttagggttatacggtaggtg

SEQ ID NO: 586 - DNA, 20 bp, Artificial
  Synthetic probe sequence
ttagggttatacgataggtg

SEQ ID NO: 587 - DNA, 22 bp, Artificial
  Synthetic primer sequence
ggcccatcccacaaagatacac

SEQ ID NO: 588 - DNA, 20 bp, Artificial
  Synthetic primer sequence
ggagtggcgttagggttagc

SEQ ID NO: 589 - DNA, 101 bp, Artificial
  Synthetic primer sequence
  misc_feature (51)..(51): n is a, c, g, or t
gtagggtatagtaatcaccctaagtcatgtaagcgtgagcgtgttgcaccnacttaagtcgatcactccgttagtagggtatagtagtcactattggtcct

SEQ ID NO: 590 - DNA, 15 bp, Artificial
  Synthetic probe sequence
ttgcaccaacttaag

SEQ ID NO: 591 - DNA, 14 bp, Artificial
  Synthetic probe sequence
tgcaccgacttaag

SEQ ID NO: 592 - DNA, 24 bp, Artificial
  Synthetic primer sequence
cttaagccgatcactctgttggta

SEQ ID NO: 593 - DNA, 24 bp, Artificial
  Synthetic primer sequence
gtgtatagcatccgagaacaagga

SEQ ID NO: 594 - DNA, 200 bp, Zea mays
  misc_feature (34)..(34): n is a, c, g, or t
  misc_feature (39)..(42): n is a, c, g, or t
  misc_feature (52)..(59): n is a, c, g, or t
  misc_feature (101)..(101): n is a, c, g, or t
  misc_feature (134)..(134): n is a, c, g, or t
  misc_feature (138)..(138): n is a, c, g, or t
  misc_feature (169)..(169): n is a, c, g, or t
  misc_feature (174)..(174): n is a, c, g, or t
gcgtgatccaccagcctcgctaggttcgctggcnggccnnnncctgatgggnnnnnnnngactcacatggaaggctgctgcctctctagcagcatctgctnctggctgcagctgccgtcggcgtcgtggtctgntctntcaaagtcgaagtaaaaaaacgtgagtagtngtacnactgtagaagtttcttttgtatagca

SEQ ID NO: 595 - DNA, 16 bp, Artificial
  Synthetic probe sequence
catctgctactggctg

SEQ ID NO: 596 - DNA, 16 bp, Artificial
  Synthetic probe sequence
catctgctcctggctg

SEQ ID NO: 597 - DNA, 14 bp, Artificial
  Synthetic primer sequence
cgccgacggcagct

SEQ ID NO: 598 - DNA, 18 bp, Artificial
  Synthetic primer sequence
gctgctgcctctctagca

SEQ ID NO: 599 - DNA, 101 bp, Zea mays
  misc_feature (51)..(51): n is a, c, g, or t
atgctgaagaagcgcggcaagcgttccagtgttattgagtcttgccttcanagctgtctggggatcaactgtgtacagtccaccgactgtgagtgtgttct

SEQ ID NO: 600 - DNA, 14 bp, Artificial
  Synthetic probe sequence
acagctgtgaaggc

SEQ ID NO: 601 - DNA, 15 bp, Artificial
  Synthetic probe sequence
acagctttgaaggca

SEQ ID NO: 602 - DNA, 26 bp, Artificial
  Synthetic primer sequence
tcaacaaatcagaacacactcacagt

SEQ ID NO: 603 - DNA, 25 bp, Artificial
  Synthetic primer sequence
caagcgttccagtgttattgagtct

SEQ ID NO: 604 - DNA, 101 bp, Zea mays
  misc_feature (51)..(51): n is a, c, g, or t
ccagccgaggcacctgttctgcgacaacaagcaggagcaggacaaggcganacatctgatggtttgcctggatctgccctgacgtcgctgtttcaacatgt

SEQ ID NO: 605 - DNA, 14 bp, Artificial
  Synthetic probe sequence
aaggcgagacatct

SEQ ID NO: 606 - DNA, 13 bp, Artificial
  Synthetic probe sequence
aggcgaaacatct

SEQ ID NO: 607 - DNA, 25 bp, Artificial
  Synthetic primer sequence
aatcagatacagggagcatcattcc

SEQ ID NO: 608 - DNA, 20 bp, Artificial
  Synthetic primer sequence
ggcagatccaggcaaaccat

SEQ ID NO: 609 - DNA, 190 bp, Zea mays
  misc_feature (90)..(90): n is a, c, g, or t
cacagcttttgctcgcammascaacccgaaccatcaagttwggtgcacgcgtacgccacaccaaatgcgatgccaagattcctacagtcngattagttgccaataccctgattagttgctgcctactacagtaatgtgtgagagcaaaacaggtgcagctgcttccatagagtaacaacmcagastagaa

SEQ ID NO: 610 - DNA, 18 bp, Artificial
  Synthetic probe sequence
ttcctacagtcagattag

SEQ ID NO: 611 - DNA, 16 bp, Artificial
  Synthetic probe sequence
cctacagtcggattag

SEQ ID NO: 612 - DNA, 17 bp, Artificial
  Synthetic primer sequence
acgccacaccaaatgcg

SEQ ID NO: 613 - DNA, 23 bp, Artificial
  Synthetic primer sequence
gcagcaactaatcagggtattgg

That which is claimed:

1. A method for producing a Vip3A-expressing maize plant having increased male fertility compared to a Vip3A-expressing maize plant that has reduced male fertility or is male infertile, comprising:
   a) providing a first Vip3A-expressing maize plant comprising a quantitative trait locus (QTL) associated with increased male fertility in Vip3A-expressing maize plants, wherein the QTL is located on chromosome 5 and is flanked by and includes marker 7 (SEQ ID NO:561) and marker 8 (SEQ ID NO:566), and further comprises a haplotype that comprises i. an A polymorphism at marker 7; and ii. a G polymorphism at marker 8;
   b) introgressing the QTL of a) into a second maize plant; and
   c) selecting a Vip3-expressing maize plant comprising the QTL, thereby producing a Vip3A-expressing maize plant with increased male fertility compared to a Vip3A-expressing maize plant without the QTL.

2. A method of producing a Vip3A-expressing maize plant having increased male fertility compared to a Vip3A-expressing maize plant that has reduced male fertility or is infertile, comprising:
   crossing a first Vip3A-expressing maize plant with a second maize plant, wherein said first maize plant comprises within its genome a QTL associated with increased male fertility in Vip3A-expressing maize plants and said second maize plant lacks said QTL, wherein said QTL is located on chromosome 5 and is flanked by and includes marker 7 (SEQ ID NO:561) and marker 8 (SEQ ID NO:566), and further comprises a haplotype that comprises i. an A polymorphism at marker 7; and ii. a G polymorphism at marker 8,
   thereby producing a progeny Vip3A-expressing maize plant comprising said QTL and having increased male fertility compared to a Vip3A-expressing maize plant without the QTL.

3. A method of improving seed production from a Vip3A-expressing maize plant, comprising:
   a) crossing a first maize plant with a second maize plant, wherein said first or second maize plant expresses Vip3A, and wherein said first maize plant comprises within its genome a QTL associated with increased male fertility in Vip3A-expressing maize plants and said second maize plant lacks said QTL, wherein said QTL is located on chromosome 5 and flanked by and includes marker 7 (SEQ ID NO:561) and marker 8 (SEQ ID NO:566) and further comprises a haplotype that comprises i. an A polymorphism at marker 7; and ii. a G polymorphism at marker 8; and
   b) using a progeny maize plant comprising said QTL as a pollinator in a cross with itself or a second maize plant that functions as a seed parent,
   thereby improving seed production from the cross as compared with a suitable control cross.

4. The method of claim 3, wherein said method reduces the ratio of pollen parent to seed parent maize plants required for seed production by at least about 25% as compared with a control cross.

5. The method of claim 4, wherein said method increases the number of seeds produced per pollen parent plant and/or seed parent plant by at least about 25% as compared with a control cross.

6. The method of claim 2, wherein said progeny are identified by detecting the presence of said QTL in a nucleic acid sample or amplification product thereof from said progeny.

7. The method of claim 1, wherein said second maize plant comprises a vip3a coding sequence.

8. The method of claim 7, wherein said first maize plant and/or said second maize plant is hemizygous or homozygous for a vip3a coding sequence.

9. The method of claim 7, wherein said first maize plant and/or said second maize plant is homozygous for a vip3a coding sequence.

10. The method of claim 7, wherein said first maize plant and/or said second maize plant comprises maize event MIR162.

11. The method of claim 8, wherein said maize plant that is produced is hemizygous for the vip3a coding sequence.

12. The method of claim 8, wherein said maize plant that is produced is homozygous for the vip3a coding sequence.

13. The method of claim 4, wherein said progeny maize plant comprises maize event MIR162.

14. The method of claim 2, wherein said first maize plant and/or said second maize plant is an inbred maize plant or plant part, or an elite maize line.

15. The method of claim 14, wherein said elite maize line is NP2222, NP2660, NP2276, NP2391, NP2460 or ID3461.

16. The method of claim 2, wherein said QTL is associated with one or more of increased pollen production, enhanced tassel formation, enhanced anther formation, increased male fertility in plants grown under drought conditions, increased male fertility in plants grown under elevated nighttime temperature conditions, or any combination thereof.

17. A maize plant or plant part produced by the method of claim 2.

18. A breeding program comprising the method of claim 2.

19. A seed production program comprising the method of claim 3.

* * * * *